United States Patent 12,642,819 (COMPOSITIONS AND METHODS FOR TREATING INFLAMMATORY BOWEL DISEASE) - sequence listing, part 28

SEQ ID NO: 10 - DNA, 6091855 bp, Bacteroides thetaiotaomicron (residues 2,030,620-4,061,238 of 6,091,855)
  modified_base (1025319)..(1025417): a, c, t, g, unknown or other
  modified_base (1096983)..(1097080): a, c, t, g, unknown or other
  modified_base (1430262)..(1430357): a, c, t, g, unknown or other
  modified_base (1656601)..(1656609): a, c, t, g, unknown or other
  modified_base (2183767)..(2183864): a, c, t, g, unknown or other
  modified_base (3844963)..(3845060): a, c, t, g, unknown or other
  modified_base (6049030)..(6049096): a, c, t, g, unknown or other
gccagatgcactaacagttattgcaccagcctctcgatttgcaacattatgatagcaactaggttcttgacctcctgccacgacaggaacttctccaggtagaacatcatttcttgttatcgtagcacctttctcgatattgcaaatatctccaagaggtacttgattatcgcccttaaacatctcgataaattgcgatttgcaaccaacaaattctgaatttatcggcttgtctatatattgtctcaaaggtttcttgttcgcttattgatggtaacccaatcataaaattttcaaggaacgctgctccaactcttctttgtcctccagttcctgacatgtttttagccgcatactctctaaaaattggcattcttgttaatgttaatagccaataaggatttgatattccatcgattggacgtagtacatgaaactcagttgagcccataccaattccatttgtaagcgcttcagcaattgctcctttaccgttttccatacatggtgtaatcttggcaaatagaacatcgttattctcaaagtaagtgaatcctttctttactttaccatattcttcatttgtcgctccatcgatatatccatcctcatttactgcaggcataggtacaaatgataccagatcactatcactaattgatacacttggtcttctgggattaatctgacagcagtctcctaatttcttcaactcatttttttgtattgaagaaagagggtttccaaacatctcgataaattgcgacatactaaccaatgaatttatgatgagacaattttacattattctgattcaccattgcatattgcaatgtcgtatcgagactctgatgaccgagtaggtgctggacttgctcaataggcatgcccttatctattgccattgttgccaatgttctacggaatttatgtggatgcacttttggaatattcaaatctttccccatctggcgcagtctaatctccactccgctaatctgcaatctatcataaggagccaggagtgagacaaacaacgcttcattgttgtcagtacggctgtttatgtatttctgcaaatgaatctttgtacgagcatcgaaatataccttacgctgcttatcacctttgccggtaacaatacactccctgttgtggtaatctatatctgagcgattgagcttaaccaattctccaacacgcattcctgttgatgccaatagatctatcaatgccaaatcacgcggatttgagcaatggtcccgcatcaattcaagagattcatcagtatatgtttcctttacggttttacccacttttactttatggattcttcgtacaggactctttactatatagttttcttcttctaaccaagaaaagaaactggatagtatgcgtcgaatattatctaccgttaccttgctcgcgccactctcgctttgatatgtatttaaataatgccgtaaatcatcagtagttatgtggataacctctttacccaacttaatcaatgcattatttatagtactgcgataataggcgattgaattaggagaacatccttcaactttcttggctgagataaaattctctaccaaaatctgattattactttctgcattgacagaatctttttcagtcacgacaatgttacggaaggtgtaatcaagcaccttacgcaactgggccaactgctcattattcaatgaaccgagcatagcctgttctatttcgttaatcaagttcttaaccataatcttactatattataaaggttcgtcaattaacgcgcgactaattattcatgcactacaataatatgaacttagtcactcatgagtgaccaagtaaagtgactaagtcaatgctcgtttgtatttttggctccgactattaggtttctcgggaatagtcattaccaagaatcctccctctataagtgggtcaatatagcgatgctttacattatatctgtgtttaagaccaagatgctccatgatttcagccatacttcgaggagtagaacaaaaatcaattatatcattaagtgtgtcacttaacttagtcactgacttagtcacattttcctcatcggtgaccaagttaagtgataaagaaggcctcactataacctcaaaagctgtaatcttatccacattgaacactggttcgggatttccattctcttgcaataagttctttacacgctgaattccacgattgaacatgttaacgtacttcaatccacgcatagcctctgcaacaataggattacgataatcatttaccgttgggaagttctcaggacgagcctcaccatacaatcctccagcattaagaatctcaatacgatcctcatattgataaagtcgaattggcatattggactggtaatccctatgcatacatgcattcatcaacaactctctaagagccaagtcaggataattcaacacattctcctcacgcagcatgctaataggcatagggcgagaagtcaccacagcatccctaacaaagttttccaattgcggtagcattttactaagacttcctttaatctgtcgttcattaacgatttcactaccacggtctttacctgcaaaatgaacgtattgtacatagcacccatgcatataatactgagggtctttaccaaaaagaatcattgcagcatttgtaggacattcatgtgtaagatcatacaaatgaattgccgccaactgttccttgatattacggctatcgctagccaatacttcgtggtcaattatctgaggaagatattctcttttaataaagcctgtatcaatatcattgatggttgcaccaaagcaaggcgtagcatcgaatgttgccatatatgatgttctgcgttcaagcaatattcgttcttccgcttcactggcaatatctctgcgagggccaatgcgaataaatgtcctaccacgatatcttacaggaggaaccaatgatggtgacacttcagcaacgagcaaatctccatcctcgtattcaaatctttcgacagacataataggaagaggtaatatattaccatttgaacgtatggctgaaatcttttttagtaaatcatcatctactttcagtcccgataaagttccattatcgtatgcaccaagaatcagatacccattctttttagaattgggcaaatcgtttgaaaaggcacatatcgcttcttgaaacttgtccatatcaccagtagatgtggtacgctctattctatatgtctctgtgctcttcaacagctcacgtacttcttcttttgatatcatattctcgttctattaattatttatcaaaccaattcttaatgactttaaatatttttgttgtaaaaaactccaacaaatagtctttattattaaagaactctaaattacgattaagccaacttactggtccccacaaaaagacaatagttgaaagaatattaaataaaattttccaaatattactccaattcgaataatctacaaattccaaaaatacaataaggaaaactaacaaaagccatataacaaatacaattatacttgatatacttttagctatttttaaaaatttggcatcatgattacctaaagtcccagaaagtgaattgatttttaagtttcgggatatttctatttcttgtaaaatctctgcggtagttctatctgtatataaagaggtatcattatatgtctttgattcaagtaattcctgaacaattttagacgtgttgatatgcatcataatctcctcagaaataggagtagatgcattaatttcttctacttctaaatagaatctatgaagaatatcatcagaaagagatagattattataacattcgctcaataataccttttcatttatatcactgcttgtatcaggataacagaaccataaaatagtcgacagaaaagcgtctgtcatacatacaggaatggaatgacaaacattactcaattcagggtgctttgaagcatatgcaagagccgtgttggtcgtaatcaatattgcattacaattcttgagattagaagctggagagtttcctctcatacgataaatatatgaaattacgtcaacatcattttcaattgtttttcttttattgtcatctatctcaacattgttatccaaatatcgtttcattaacaactcgttgagttttaccgaatcaatttcagaatatctattaggcattgaaggagcctcacatattgaaatattccacttggaaagaatactatctaacaactcacgtttgcttttcaggaaactcgcagatattttattacgtactgcatatttcaataaccttgatgctttatctagagtataatccttagtatataataaatggattgtagaattgaatgtttgcaacacttcctgataatgctgcctaaaaatgataaaatcacatccttgcttttcaagaattcctaacaattcactagacatgtcaaaattaaccttttcattcaaactgagtagattaaatattataggtgaatctaaagcaattgtgactccactcatctttccaacataattacatactcctttcattgacaagagagatgccaaggcatgtcctttcgctatgttcttaaaaagctgaaatgtttcggaagaattatctttgctccagataatgaattttgaaagaatataattcagtttcttggattttttcgtttgcctagctactctatcaatcaatccttcttcattaagtataatatctccatcatgattctctaagaatcttaatattccattctgagtttcttctatagaatactcaactccaaagttatccttagaaaataacattaatttttgacataactcttcaatactcgaagaattgtcagtttcatggaacttttctatttctttgataagttgctgtttgtttatgttataacatcctccacctaaagaaagaatacctaatgaggtcattctctttaatagactaacaaaaactccttgatatatttttgataagccatattcctcagagaaccatttttttaagtcttctattgaaactgtttgagatgcattcttgttaatacatttgcatgcaaatggtacatataagtcaatttggcttatacctttctcagaaaagtaattgagaatagtatatgaagttattgttctattaatcattttgattgattttaattgttaatcaaactttttataacttggtctattgcctctatcgatttacggagttcaaattctgatttatcagcctgattgtaaatgctggcaaactcttcttgagcctcaattggaggaataatgatcttcgcatttccaatagactccttgttaagtgtctggccttttactgcttgctttgcacctagtaaccagttcttgtttgcaataagaaaatgcaggaagtcgatattgaatttcttctcatcaaaaccagcaaaagccattattgcctcgttggtatatagatcttctgaggtaatagcagttcttcctatagagagcttaaaactcattataatcgtacctttgggcactgctttgattcctgaatcagctattgcatagtctgtaatgtattcgctagtatctcctgtataacgcgtgtatgaagacatgtcggatatagaaacccatttgtgggttccattatcccaacactcaggattattgcgtgctggagtcttacccatcgatagcttaaattcatcttttactaatgattctgtccaacccttgtcattagtattctgatttccaaacatctcgataaattgcgatttcaccatttctcgagtagcatcaagaagcttcttatatgattgttttaggcgataagccgacatcactttttgggcaatttctaattgctgcttaattggaggcaactcgaattcgtaatcagcaagagtactccagtttagaaagtaattaacaccaccacttttattttcttcacaataattccaaaaatcatcactttgcataattattgctaaatattcttgtgtgagaatactttcatctttagtttctattacaaaggtcttttctgaacagattccatcaaaatcagcaatactacacttctttaaatgaggatttcgtgtaacaaatagaatttgccctgcagtaaagccgcaatagaacattggtccaattgttgaaccttttattacacccttctttgtaacatataactcacatgaatctatatgttcaccacctacataatagattttctcagtattgaatctatcttctcttgtatatgctcggtgtgcaacctcagaaaacttgactatgctcataataaatctattaaattggtaaatgactcgtgtaaagactctgagtttgacttccaattttctaaaagttcagaaatatcttcaatatcttttggatcgttggattttacatagaattttggtgaaatgctatacttgttatcagggatttcattattgttaataatctttgaacgtccgtcaatattggtatatcgggtataaatactcgttattattgaaatatgctcattggttaaataactttcagtatttttccgttccactaaatcggtagcctttattaaaagaattttatttttcctatcagttggtttatttgatcgacaaataagaatacaggcctccattggtgaattaaaaaataaatttttcccaatactaataacggcatcaataagatcgttctgaatgagtttttgacgtatatctttctctataagtctattaagaacaccatgaggcaatagaatagcacatcttccatgatcattcatagatgataaaatatgctgtatgaaggcatagtctgctttagactgaggcggtgttcctaagaaattgcgtccccatttgtcgtttataaaagcctcacgatcccatgtctttatagagtatggcggatttgctaatacgatatcaaacttacgcaatttgcttccatcgacaaaggcggggtatgctaaggtatcttctctgacaatagaaaagtcttcaacgccatttagataaagattcattcgagcaatagcactggtaagtgcattaatctcttgcccaaaaacctttactccttgccatggttcaccctttttgcgaagaaagtccaaacattttacaagcataccacccgaaccacaagtagggtcatagatgctttcgcccggacgaggttgaagtatctctgccatcaaatccacaacggtacggttggtgtaaaactcctgtgccgtattaccagcatcatcggcaaacttgcccacaagatactcatatgcctgtcccatctcatctgctggacacgctttaagcgacaaattgtaacgtgagaaatcttctatcaaagaggtgataatgtggtcgggcatcttggctttattggtccacccatctttagggccaaagataccttccaggcctccaataacacgtccatcggcatgttcgccagggttggcttgttcaatagcaataaaggcttcgaccaaacgctggccaacattctcagtacactcacgtacatcacgccaatgggcaccatcgggaatacgaattactaattcttgagcttgagcattggcatactctataccgccttcgcaaacatagccttcaaactgctcatcgtatacgtcagaaattcgtttgaagaatagcaaagggaaaatatattctttgtaaccagcagcatcaatctgaccacgaaggcgagtggctgctccccaaaggaacgatttcaagtcttccaatgaaataggctcatcgggatttctataatattttacaggttgttccatagggttataagtttatcagttttctaaattcttcttcaaatctctttacctcctcgtatgccgccttgaactctgcaagcacttctgcatatggacggatttcctctttgtgatattccacgtatttattaggagaaaggtcataatccttagccgcaatatcatcaagagtcaccactttagaaaagtcttctacatcctcgtaattggtgtagagttcgtataaacgatttacatcttctggagaaagtatattctgtgcacgctttacggtgagaatctttgtgccatcaatcatcagtactcgcgcactatgtgcagccggtttcaaacgtcttaatatcaagaaacagggagaaagaggtgtgccatagaagagtttatcgcctaatgtcacaacagcttcaaccaaatcgctctttaccaatttctcgcgaatgcggccttcttcatttccacgaaataatacaccttgaggcataacaaccgccatacgaccattgcctgatgccatacttttcaccatgtgctgaatccaagcataatctccacacgaatcactgggtgttccccaaacattacgaccatatttatctgaagaccattctactgaaccccatttctcaagtgagaagggcgggttagctataacgcaatcgaacttggcaatctctccattctgcaaaatcttgggtgaacgaagtgtgtcgccttgcataatattaaagtcactggcgccatgtaagaacaagttcatctttgcaatggccgagttgacaacgttcttctcctgtccgaatatgcttccacagcaaagacttgagtgattcatgtgctgtaccgcctcaatcagcataccgccactaccacatgctgggtcatacacagtctcacctggtttcggatcgagaatgcgtacaagcaagcttacgaccgaacgaggcgtatagaactctccagcttgagccttactgtcatccgcaaatttcttcagcaatatctcatatgcatcacccatcaaatcagctgggtaatcattgttgcccaatctacgggtggatagatgctctatcaaatcacgaatcttaccatcagaaaggtttttcttatcggtccacttctgtgcgctgaacatcgacaacacgccgtatagtgtatcaggatttgctaactctatacctcgcatcgcaccaacaattgcagcaccaagattctcggagcgttcgcgaatatcactccaatgacaaccatctggaattacaaaacgatgttgttcaggcaaggatgcatactcctcatcgccaccactttcttcaagcgcagtttgagtctcttcgtcatatacatcagatatacgcttaaaatagaggattggtgttatataatctttgaagttatcttgactcacaggaccacgcaatatgttgcatgcctcaaacagaaagttgtacagattctgcacaccttccattttaagggttttctcgtctttgggaaccagagattcttctttatttttcttttttgccataatatattgctatcatatgaagatagtgaattattttgtagagttaagaagctcttttacatctatatcgagcactcgagctatttctcggagtgttgccacatcgggctgggatgtattagtacaccatttagaaatggttgcagggtttttgcctaaaacttctgcaagccatttgctagttttcttcttttctacaagaactacttttattctattcatgtcgttcatgacgtaatttttattgctttaaacgcaaagataattaaaagtccattaaaacctgcaattcctataataattcttttgcaaaaatgtatttttcccttatttgaaaaactatcgggcgcgccccttattctgctttacgctgtatttagccataatgtatttgacggcatgtgaaaagcatcttctttggaatgcaaaatcaggttcattaggtctgcgaccatcccaacgtaggtctgattcatttcctccgcctccaccccctgatggaaccacataatctccacctataagagctgttgctactgcacataactcatcacgtaaagatggtatcgaaaggtagtcaaatgtttttaatgccaaattagaccagtaattcatacattcagtaagagtcttgttttctgccttcaacgtatggacatctttcatatccaccaaaatgttctggcgaacagcttcaacttgattagcagcttcattcctataaagttcttccaatttacgacccatagcggtaaattgcttctcgataatcgtattttgacgttccaaccacttatcagttccaaacattggcggtttctctgtaatctgtggagcattaaactcaatcttgtaattcttgaacggtctattcacagaatgaatgttttggatatctttcagtaacgagtctaattcctgctgctttatcatcaatttggtttccttatcatcgagtctttcttggcaatcatgtatcaaatcttcaatgcacgctttcttgttttgatattcagccaatacaacacgtcctgcagccaaatctttctccaagatttttaattcatcggaaaacattttcatttcagcctcgatattatctttcatggtttgcaatcctctgatggccttttccatcttcttctgctcctttgcgagtttacggatataatctcgcttattcagatgctggatattgcgaccttctacgctgtcccccctctccaaaccgtatttgctaccaacttcttcatagagtgaggtatgcatttccttgagtattgaaccatactcatatttattctttccgaattttgcagaccacatcacacattcacggccacttttaggacgtaccccaacaggaacaataagtgcatgaatatgtggtgacgtttcatcaagatgaacctgaaagccgatgatattctctttcccatacctacggcaacaccaattatatacatccaaagcccattgctccacctctttgcatctatgtatatggctattgtccgaacctttatccagttttagatcctgagtgccaaatgccattcccaatgtacgctctcgattgccaccaaagatgagacgagcacaacaattgggctgaatcttactatccgctttgaatggacgccaaccaagttcatttagccgttcttgcaagcgaacatcaagtcttttatcctgatagcccaaagagtgaatcttaccatcggggccaatctcaaaattaagcctcattctggttttgtcgtagttattaatagaatcgttgttcttagaatcaatcatcttatcatcccatcttctttcgttttcattggcttctgctgcgccaaaagatttgcatgcatctaaatgcatggcttgtttaatactttcattcatagatctaatgttttaaaagttacacatttgagcttgctcatttagagttgtgtttgccaaccacaaatgggagtttcttgctgcaaagcaaaaagtccttattgtgttatggattttattttaactcctggaacaagttcctttaccattttagttttgtacaatctaagtggattctgtcatctgctgagcatctatcaactccaagcctagagcgtcaatgagattttgtaaaagagggttcttctcaatcatcatttgtagaatctggtgtttggatggagagaatagatagtagtcagaaatatcaagtcctttagatcgttcttcttcggttgctatctgctcaagcatatccgagactacaactctgctacagattcttgtcagaattatcgatttctctttccacaattgtgtagctcccaagtcaggaattagagttacatccctacctttaagactatgaacaaattcttctttgaagcatccattaatgccgccagttgccacccaaacatagttcgggatgaagtgactcatgacaatagccgttttttcgctttccaccaatatgaccggtgcatcaggatatcttttcaatagatgttcgccaaatagacattgcttcagattgaaatctttaagttgtagttcacgatgcgcccagcttacataactgtggggttctttaaccctatgccctgtctcagaattataaagtataatcttaccagaacgtacctgctcattagcatcaatttgccaaaaaactgtcgcacctccccatttagccgatgtaccaacatgatataaatggaataccctttgggcttcagcttcaccaaacaccctgcataagtatttgtataagggattcttctcaaaatgagcaagagtcgcattaaaatactctaagggaataaaagagggtggcacaataatttctttttcatgagtacttttcacaggctgtacataatcactagaccgttcttccttgatgtttgcattgggattatcacgaaagaaatcacgtggagtgtaatgataaccacaactgatttcatggtcacatttcccaacctcattgggaaaacttacaactccctcttcatcaacatatttcacaaaacatcgaggtctctcacaactagggcaagcaatcttgcttcccaaactatacttttgcaaatgaaatctatacttgctcatggatagataagtttattcgtttgcactatgcacttttgcactatgctttgtctgtaattcctcaacttgggttgaaagtgcaatagtgcaagatgcatttgatgtttggtgttgaatttttcgatattcgccatgcttggtttttttcagaattggctgctttgcctgacagagtttctttaatgcatagaatacggttcttctgggtatttcatatattttcgcagcagcgatagcatcgcttgctgtgaatgtattacccaactgagataaccagtcttcttttacatcaccgatagtattagacaaaagtatctcttgtatcctatggtaagtatcttcatagtaatcaaccatacgaatagcggatttcacagaagacaggcttactggctgcatatcttcttcgcctacagcccatttcattatctgaaatatcaacgataaacgtcctgcatggccattaagtttcatgctgcgactctccacatctgcatcatcatcaatgctattaacattatcaatgatattgttataccaatcataaaaatacacctctgcctcctcggtcatttccaaaacttttggttctgcaacattccttgtttcattaatcgtgcagggaatttcaagtactttgttgagaatagtcgcccattgccctgctatatcaggtttaggaacactattatcatttcttctccatcttgaaatcttcctgtcttttggaaaaatgaagataaacctatcaaggaatccgttagcaatgaactcttttctgaacacctcatgtagcatgttggtctgtaccgttcctattacattaatacacggcgttttaacacgaatatgacgtgatgaggacttgcgtagaactttaatcgtaccaccactataagctgttagcagaagttcaataagattattattgccattgtatctctttgcgaaattgaatagcccaattatctcgtctacaattatagctatccctcgtggattgcgccaatgagcctctaccattgcttctggtgtgaagtcagatataatattggtcaaccacttgggcactttcaatttatcatttcctccgttcgcctgcttggcacactcatatttctcaagttcctcgctatatttctcgtcaagacgatcgtccaaatcgttgataggtttgtaaaggaagttaagaggaggagttttacctaaaccaggtcgcccaataagcatcatataaagagatggactatctttccactcattcctgatattgatttggtacgaattgccaatggcagccgccatcgcagatataataatggatgccacatactcaacattgaaattttcataacgagaaaggttcagaataatttcctgaattttatcagggaaaacatccaacggcaatcctccatcaagattatgctctacctttgctcggagcatattggttaaatgcaacttatcgaccataaccacctcctctccgttggggtagttcatcacttgccgcaaaggcatcatagtgaaaattgcgcaggaatcggtctacatcttcttgagtataccaatatttgtctccttgacgtgaatatccaaggtagccattatcacgcaatttcttcagatatttttcctttatacccaattttgccatcagtgccttattatcatatagatgattttggggcatttgatgttgagccaaagccttttcatgcttctctacagtgtggagaattttctccagcaattcccgttcacatagggactctacattcttaattttagccatatacaatttaaattatggctcaactgtcctgatgcgcactcggacttttaagccgggttattttgccatggtacgattgtgcacatcgtccataaccgcagcgaaagtatagaatccttaggaggtgaaaagttaggatgaattaggctaatgcgttaggaataatgttaggattgagttattttgatattaggattgaaatataaccacctgattataaacaaaaaagagtagccaagtggctactcgaaaaatttatcaatctctgttgattttgttggtactggaagatctttcctatttgaacgtgattgccccaatcctgaaacatcaaataaattatttagttccgtatcagggaaaaaggcagttcttccaaatttccaaaattccctatcatcaatattggagaccgttggtttatctccacaatatatgcgaccacacatatatgctaaaagaactttagactcgttccatatatagtgtgtgccatcttctttcatataaccagcttctatggcctttgcaaaaactttacgagccaattctgtatccaatgtttcagaaagaataatttcagcatcaacagatacaacttcttccacattcttaatatttttctcacgaagaatttctgcaccaatgactaatgcagctgctgaaatcagaaacataattgtgccccaaaactctgatgagccagtttcgttatcgctgacagggtttacaaccccaagtccaacgagtaataatgtgcctacgaataatgtaattgcactcgaccatagaattactcttgcatattttttgaagacgaaggcaattgccaacaaaataacgcaaagaccaatattaagaaatataatctgcaacatacttcattcaaattatttctagagttttaaattcatcttttaaacgtgccacctcggacgaaagagtctcaggcagaaatctggcatatactttctctgtaacatctgtactgccatgccctaaaaggcgacttactacagtcattgacaaccctttgtttaatgcaaacactgcaaatgagtgtctagctacatgcattgacaaattaaacggcaacccaatctgttcgcccactaccacaagtgactgattgatgcatttagtggcattattgcgagctttataaagggcttcagcatcatctaggtctaattcttctttcacaagattgaatacatatttgcagccttcccgtttttcttgccactgtcttaagatagatatagcttgctctgtaagaggaataacatggcgtttgtttgtcttaatcataatttttctcaactctttcttctcaaagttgatatgcccccattgcaatgtcattacatccacaacacgaagtccacaagcatggaaagcaaagaaaaaaatctctaaaaactctctcctacgtggttcaggacaggttttgtagtattccaatagagcaagtaattgttctttattcaggctcttcccatcaaattcactctcctcttccgacaaagataccttagtaataatacgcatatcctgtattcttgcattaacagaaggttccagcatacccatctcacatgcgtaagcacatgcttttaatattggtgttaaagagtgattgattgttgcatcactattctgctttatctctctacgccacaaaatatatgcatccaataattcaggagtgatatcgccaacatagatagaatcggcacgatatgtaccctgtttcgtggaacgaaggaaggtttggaatatattcattccgcttttaccgttttcatatcgactacggccaatcttgtttcttgagtattctgaataaagacgctccaatgtgaactcaacaaaatcttttccttggtctgggcgcgtcaatggcttatctgcaaggaatcccgaaataatgtcagcagtgatttgattgggatgcttttcattatactctgcaagcatagagtcaatccggtcaacacgtgccaacaacagttgattgagacgtttgtactcagatccataactgacacgaatttctccacgaccttgattgccgttctgattccagtcggtttccttaacaaagacatttgttgtcttacgtataatttgcctattccaagtatattccaactcaatagggtaggctttatttttgtcagactccttcggtgtgcggagacgatatttgcccaacggatataatctcttcggtcttcccatacgcttccttttgttttaatattcctgaggatgcacaaaggtagtgtattttagacaaacaaactctgttttcaagaagaaaaattgcattttagacaaacaaaccacaccatttaagcctataaaacaccagcgggacaaacaaattatttttgcttatcccgctgatattaaatcatttaatttgattttagcttcttaatattcctcctcgttaaaaaagaaatcttctttactaggataatccggccaaatatcttcgatactctcatagatttcgccttcatcttccatctcttgcagattctctatcacttcaagaggagcacccgaacgcatagcgtaatcaatcaattcgtccttggttgccggccagggagcatcttccagtttcgatgctaattccaatgtccaatacataatcttgagtattaaaaagtgaatacttattttctatttttcggcaaaagtataataaaatctatcatttccaactattatcccagaatatttcactattttgttcatcaaaattaatttttcgggataaaacaaacaaataatctgataatctgttgacaaaagctaacacttcaggagaaattgtacaagtttcggacagagtcagaatgcgacgttcggctctccggcaaatcgtacggcacacatgacaaacagccgctccacggctgcctccgggtatgataaaggcacaaagttcgggcaactgttcgtccagcttatcaatctcgcgctcgatgcgttccacatcttccggagtaaggatactggcggctttcagttgtgttttttcctggtctgttgccaaatgcgaaccgatagagaatagcttatgctgtatactcaggataaaatcccggtctgcctcatccagcaaatacgtattcagccatcccagatgggaattaagttcgtcaattgttccgtatgcttccaaacgaatatgggtcttcggaacgcggcttccgccgacaagactggtagttcctttgtcaccggtctttgtatatacaaggctttttttcataaacgtctatttttcatcattactatatataagattaacgtataaaggtgatcagaagttgacgatataatgctgtttaatctttgttgtatcaaaaaaaagcaagcctgcatcatacaagtcaaaagtgattcccacccgctcatcattctgtaactgtttccaaagatttttcattgcctttgaatagcagatcccatgaacgacaaacaaactattcggagtagtccgacgggaacagatgttaaaaacttcttccagcaaagccggattccgatagtcattcagatacagaaagtctaccggagtatcggcatccagaaagagctctgataagtcagaagcaaaaagatacccggcagaaggtttggctgactgtaaatataaagaggctgccgagggctggcctacttctatgatagtggccggttgcactttattcaccaggcggaacaacagacggttgattcttggtattcctttctcccatctctgtgttgtgatccgctttttctgttccaccttcagcaggtcgtatgcataataaggcatcttctcataaatcacatctgtgatcagactgaaagcaaaaggagagtgcacaccatatccacaacggtagcggaaacgggagagccggataaaaggtctttttaggtaatacagaagattcataaaccagtctttcattttttttgttcgtgacgcaaagatatattattttattgaaaaaagggccggctcccgcggtggaccgacccttttaatcatttatttcaagtaactactgcagtctgaatactacaggtacagtatattttactcgaactttcttaccgttctgcactccgggcttccactttggcattccacttatcacacggatagcttctttatccaggtaagcatctacccctcgtacaactgtcggattagtaatcgatccgtctttgtctacgacaaactgaacaattacacgtccttgtgagcccatctcctgagacattgtcggatatttgatatgagtactcaaatatttcagcaattcagctgaaccaccgggaaattcgggcatgacttctacacttacgtgaataacatcttcctcaacttctttagtttccactactggcggtacccaaacaaccttgtaaggttcattcacattgtctggtactactgaaacgttatccgtcacctcttcggtatcatctactatttcgaacaattctgttactttagtttccggtggaggaggcggttccagtttctcttcagggaatgtgattggaacgagctccgttacaaagatggattcatcatcagatgatactgccgcaactcttacatcatgctgtgtccattcgaacgatacgaacatgaaagcaagcgcaacaaccaaacccatcaacaaccaagaacctctttgattctcaattgcagccttttttgattttttggcttccataaaaaatgtgtttaagtaattaataatagaaaatatatagcatatatactacttttcgttttctgtcttaagcattacttaaagtgctctctagctgcaataaatatagtatttttatgaataggatgtaactttagttcttgtttattttattctttttccttcttttggataaaatttatgaatattattccaaattatcccaacaagaaataccatcacgtttcagtttcaaaactaagtaacaaattagcaatcctattagttggaaaggaatagactccattgcaatagatgcaaaagaagctagtatacaagcggttaacaatatccaaaaaccaattctcttccaagcaaacaacaatagcattcctactacgacaactatattacctatgccacagaaataataaactaataactgtgaagaatcagtgcaggcataggtaccccatgcccatttagggaaaaaattaataacagaacaaagtagatttaaaatgatgataaaaaagaaacaaaaacatttcgacgtttaggcgggagtgtaatttaaactctgtctggtttctatttcttttaaatcacaacaaatataattttttctttttggatttacaaatgcttcttaaggtagtttttggatgtgtgcaagggcggcgaagaatgagccgtttatatacccttgctcacatccgggaactaccttttctttgcgtttgaaaagcaaaaaaggggaaatgggttatatcgccagaggcattctctctccaaacttgattcgtagttgcccggcagttaacgcccaattctggagcggttgcgtccatttcttggagatgttcatcacagccaggtagatcaacttcatcaatgccatgtcattgggaaagacacccttggttttggtcacctttcgtacttgacggtggaagccctcgacggcgttagttgtgtaaatcagtcttcggatatgctcatcataagcaaaataggccgatagattatcccagtttcgtcgccatgattccaagacaacagggtattttttaccccatttatcttgtagtttatcaaggttgagctctgctaaatctttattaggggcttgatagactgttttcaaatctgccataaactctttttgatcttttgaggctatgtatttcaatgaattgcgaatctgatgtatgacgcagttctggatgattacctcaggaaaaatagtgctgattgcttcagcaaatcccgtgagattgtcaatgcaagcgatcagaacatctttcatgccacgtgctttcaggtcggtcaagacactcagccagaaattagccccttcgctttctgatacatacatgcctatcagttctttatggccatctttattgactgccagaacattatagacagctcgactttcggtacgaccaccatccttcaccttgtagtgcattgcgtcaagccacacaatggtatacattgattccagggggcggctttgccactccttcaccttgggaactatgcgttcaataatctcacttagggtgttgtgggagatctcaacatcatacatctcctcgatatgggaggaaatatccctaaggctcaaacccataccatacagactgataatcttggaagacatgttgtccgcaagaatcgtctcgcgctttttaaggatctcaggactaaagctgctgtgacgatcttgaggagtcacgatatcaatctcgccggccatggttttgacacgtttgctgccacgaccattccgcttattgcctttaagacgctctgaatcatcaaggtgggaggacatctcgccatctaaagcggcctctaaaaactcttttagcaacggaccaaaggctccgtctttgcccgtgagcgattcgccactacgcagttgagataacgctttgtcacgcatctgctgatactcttcactgtttctatccacaatacaaagataattgtttggggacagagttcagattacgccctctttaggcatatattttgtttcttcacagaaaagattcctatgtgtccgcttatatctttccagatctctatcagccaatattttctcctctctcatttgttgctcagcaatagaatcaagccgtagtttatcttccgtttgtatcctcatttcttttgacaatttattccaaaaggaaaaaatatcaatagagtttttaaagcaaaaatcttctactgaagctgtgtcatcaaaatgacttacctcatcaaataaaattcttgttgtaggatattctttaataatatcaactactttgtctttggggctaaatgtttccataaaaaagtattaatcataatccttaggtaataatacaaaatcatagagaaattgtccatcaatatcataataaatatattggaagctaaaattaggatccatacacttagttatgaattctacattattcctatatgcttttatgttttcaatagtggattctttcctacttctcgcattttgctaagttcttcttctttaaaatcacttcttctcacattcgaaatcttataagagtaaatcagacgattctcattatcagctaaaataatgtcttgcgcatagaggttatcatcaactttatcacctttgacaagatccttaatcgaactaaggtattgactagcctcttctctaatgtttgtatattctttttctatatggtcacatgtttttatttctaatgtattccacattgaaagaaactcagaactatttccttttaaccatagttcaataaataaaaacgtaacattattttcacaaaaagcatacgcattaccctcgtaacatctgccatatagatcgttttcgaatgagaccttcatgacttctctgcctataaaagaagattcttcaattccatttttgaacaaagctttattaaaaaggggaatttttgctttaataacttgttgatccaatagtaaagtaggatttatttgttgattcatgcacataaccattgccatcacatctattatgtcctccctattggaatgtgataatgatataagctgtccttgaggaactgactggaagttgttctatctcaaatttccaagaatcaggaattctaatactaaaataatcacattcataattatgcaagttttggcatgagattaaaaataatacccccgccaatagcatgaattcaagtttcattttcatatacatattttacttccaaattataatataaagtttctcaataaaataagacattttcagtcttaactatttggtctttacagaaatactatataaagaattatctctaaaaattgaaaccgatttatttcccttcggattccccttatcaaaatcaaatgtaaactccaaaagattgttattagaaattgcctttatctttgctttcagcactttacgtccttcaaaccctataattttaggtttttctaaaacatttggctttaaatcagctctttttaatcgcaataaccacgaattataaggtaactcccattcaaatttaaaagcttttatccattgttgtggcataatagtagacctcgtaatatacatataatcaataatagcatctccatcagtatccttaaagattactccttcaatattatatgtaatcccttgttcatctattggattttgtccttaattccgcaactcaatcgtcgttgtttttcccaaatacacacccaaaacgggaaaaaacacactatcaaaattctttcgtatcgtacttacaaccggctgagatactgacatgaccacaggctttttatcatcataaagcttctcaaaaacatcattggctgattctaaagcttttagatttgaataaaatacttgcatatattccttcatgctagacacatattgttctatttgaagaacagcagtattttcttcacaatacatttttacacatttatgagttgcattaatttcattacaaatttccaacattaattcctttttataagcatctggtcccactaaagaaaatccacgtcgactaaatgttataaaaaacggttcctcatctgaaatagtaatccagtgcagcactccttcttttttaaaataaatgacatttgatccatccttttgattggaaaagaatccttcttctttcaagaaattaatcaattcattctgaaaaacattctgtttaggagtcaattctcctcctaaagtcagatcaaccgaacataataaaaagattataattattactgttcgacgggctgcgatatttcctattttcataattatttcatttcaaacacaccaaaattttataaaattatttctctacattttataaacaagcaaactacttaccagcactaactaacataaaaagacaatcatgatcatcaaagttattatcatatcggttcaattgacataaaaggcctagtcattggtgtgtccgcattaggaacatcaaatccgctaaaattaaaataaacagtataatcactatccggattctttgctcgaaaatccgctttaaaataattcttataggttccttttcccttttctattgtaggagcatcgtattgttgcacaatttgaaatcctatacttttaagaaattcaacccactgattgtatgatctacttctatcaaatcctaactgctgaaaattaggtggcagttgatgatagctacctattattatttttcgaaccttcccatctttagtatatacccaacatgaattaattacataccgacaactgccatcgtcctcttttttcttttctgtataattcattgctttcacagccgattcagttgtattaaaatcaatcccatatataggtaaaagcgattccgacgtgccggacgaacttcgcactactcctgatgaagaagaacaataatccgccaattcctttttaagcgtactgagctgatccattaatttataaaaagtgtatttgaaatgttctgcattaaccaaatacatttcagcatggtaggcatagctatcttcaaaacaaaccacctttacagctttatatgcatttagttctttcaatgctttggacactttatcgacagaatatgtgtcattataaatataagataaccccacagttaaatacatgggagaagtatcccttttatcaatcgatatgaaatacttgtcaccttcttttttgaattgaatattaccgttagtattcaattccggcatatacccttcttccttcaaaaatagcataatgtctgagcgcaacttcttttgaatttcagtaaactcctgtgctaaagaatccatgcttaagcttaataaagcaacgagcaacaatattatctttttcatacatattaaaaattacacaagttattataaaaacaaattacttccttatagaacgcaattgccttcccttactatcaaacagtattcccgttatgaccacactagagggcaaactttctgattttatcttagtaacgaccaattttatactagcaaaatactcatttacttccgcttccgtcatttcatattttgatttcggagttttaaaactgagctcgcacgaattgctaccagtaactaaaaatgacgatgcaactaaatgtttagtattctctccaaaatcaataggaagttctgcattaaatttacgtacatcttgctgccaatttcgggaaattggttcgggtgatgaatttacccactcttttccgttccatttttgtgtcagcagaatccgtccagatgcattcgtgtatttccgagattccatctcaccatctttattataagtcaattcgattttgctatagccatccttacaatcaatagacttgccatttactcccaaataggataggctaatagcctgttgattatcattatactcatacacttctttgaagtaaccatcaggacaaagcataggtttattcattatatcataataacatttttccttctcattacctgaagaagtataactgataacagctttgtggtatccatccatacggcttatcaaaggcttctcattctcatcaaaataagcttccgataataattttccacgagaattatattcgcttttctggatactccaacctgttttcggattaataattaaatgtcccttcccatctccagcggccaaatatatcctatttccccatctgtcatatctacacagaccttctggtaccatcactttcggatcagtaggcttcccatctataccgaagaaagactgctttaagacattacctaaaacatcatactcacgagtagaacttgcccagccttcgtttgaaaccactaattgtttatcttttccataataagaagtacgaacaatataacctcgttcatcatattcatccttttggatcgcatatttatcattattataggaagtcagctccccatcttttccatagtactcaatttcaatccgctgatttctactattatagatacagacatatttatgataatctaaagaatttaacgctggtttattgtttctgtcataaacggagaactctatttgattatcaaatttatcatatttatatcttgctattagttttcccgaagccaactgttcatcagtaccaatttctattttctccagtatattacctcgtttatctcgtttataattagctccagcagaaccatttaccatcatcaactttccacttaaattataataacgcaagttggtctcattaccttgttcgtcaaactttgatatccattttgcacaacttccagcacatacggtaagattgtttttatcatcaaagaaactacgttctgtttcattcccattatcatcatatacagaattccaccctgcaatattttcattactcaaaactaaagtctttcctccagcatcataaaaagaaactttgatttgatttcctcttttatcataatctcttgctgcaataacaattccattattatctttacatggcgataaatcaactcctatgtttactaacttagtgatcagattcatgtcattatactcagccttatacccagccgttccatccgatttcaaacaaggcttttggtctataccatatgtgacatactctattatattaccaattgaatcatagttgagctttactccggcataaccttcgtttatttcatttagttttccatcaagtccataaaaccacatttcctgaacatttcctctattatcattgatatatttagcagatgagtttccgtcattagacaaacattgatttccatcaacatcataaaaagtttgatttataatatagccattatcatcaaatttacgaacgacctttgaaaatccgtcattaggtataaaacatgcctttctatctatatccagataagaagcttcgatagggaatccatgctgatcgtatatatatttaatcccagcaactccattctttttaggcaacatcaatttcccgtcagcatcttgatgaagggcatataccacatttccgtatttatcatactccatcacatacacaccaataccatcagcgtcatcataagcaggtttaccatctacagtcaaatactctgcttttacccaattatcgttctcatcataataaaatttcttcatccctaatccccattttgtagctttcggagtaccatcaaatgacaaatagtgttcgctcaaaacacgacctttctcatcacgcacatatttacgcccataaatattatgcgcatcaccaactaatacattttggaaacctgcatagcgaattgttgacacatatccattttcatcatactcaagcaaccatctggatatttttcctttttcaactccattatcctccaatacacgcacatatcctatagtttgagctcccaaagtcttttccgttccatattcatcatcatattgaaatattacagtattcaatttatcattatatgacttcacatacaatactttcccacttctatccaacactttcgcacggcttatattccccttatccgtataatacaataacatatcaagcggtctttcattacgctccgattcaccatcctcgataatattctccttgctgttcacatgagacatacgctgtagtttatgttttttatattcaaaacgatacagcctgttcacatgactcatctccctgctactcaattctccgattccctgaggaactccccattgttcgacataatctttataataatacactttcgtacgattataatcccaaaaataaactccacctcctatcatcagcaagacaatagcagccacactcgtccatacccatttgggaatcttaggaggataaatgacccgatgcaatgcctttttaaaatcgtcacatgtctgatagcgttctcccggttccttagcagtagctttatctacaatcttctgtactttatccgatacatatttataataggtccgcatccgtggtaatggctcttcaactactttcttattaatatcatattcagtaagtgtggtggtatcataaggagcattccccgtcagcatttgatgcaacattacgccaagcgaatatatatccgatctagaatctaaatgatcacctctcacctgctccggactcatataggaaggtgttcccatcaccatatcatccttctccacagattcccgattgataatagtagcaataccaaaatccaaaattttgggaatgccttctttggttataataatattcgcaggctttatatcccgatggataatattatgttcatgagcatattccactgcatctaatataggctcgaataacggacaaatcttatcttccacgatcaaaccagaaacggtctgtatatatttgtccagactaatgccatcagcatattccataatcaggtagatactacccaattcgtcaatatggtaatcatggaaacgaacaatgttctgatgattaagacttgccaaatgttccgcttcttctttcagacgttgacgggtaaaatcattaaccatgtcactattgatcaccttgatggctaccttttgttgtttaatgtatttgtgttctgctaaatacacactacccatccctccttttcctatcaaagagacaatggtataattaagaacctccttaccaatcattttattctttttttaagttaacgaaagaatgttaataaaaactcccaatccaaaacctacccaagcccaagtcgcagcttgagatgctcggtgaggagtttcccctttccaacagaaatacataatccagcctgctaacggaataaaaaaagctaatattccccagccaatttccaattcatcttttttatacgatctatattcctgtgaagaagatacaggaatatgttcgactattaaggtatttgagccgactttagtttcttgttcataaggatgagcgcctctaataggtaacaaggcataaatttgcgcccatggcagaggtatatggttggacagtaacacagtagcaccaggagcaatcacgactttttcattaagaataatacgcccaccaatattactcccgtttttactgacatctttatatacatacttattatcaaccaaagtaatttcagcatggacgcggctcactctctcatctgcaattacaatatcacagtgactacttcttcctattgttattgttttcatatactacttaagatattaattataaatccgactacaaaccctatccaaccacatatagcagccgctcttgctcgtcgaggcgtctctttcttccactgtgcccaaagtacccatcctacaattggacataccacagacaaaattccatatcctatcccaagtttatcttccttgacagatggagttggaggagtaggaggcaggatatctcctaccacttcttccattatgacagttcttcctcctttatcccgaagtttctgtatgacttcgtcccaatctaaaagatattcgcttctccctgccagccagacattcggcaatggggacggattctcaaaagaaaatggtattttaatgctcccatgacgtaagtatttgccatctacactggtgccatttgtactactatctgtaaataggagatagcgatgtatcgaacctgtacatctttcctccctatattctatttccagatggtgaccgctgatataatcactaggaatggttatgtcacactctctccgcccaacagaaacttttactctattcgggtctaccaccgtttctctaaatagtcctgatttaaattccatcaccgtttgaaaacgacgaagcatatttttatctacagccttcaatatcgcttcttgagtttgatcagataaatgcggattaaaagtctttgcacgtggaaattcatcattcaaaatagagcaaatagtatcataatcatttgaccgctttttgatggcatgagaaccagtgagcatataatgtaacaaacaacctaaggaataaatgtctgtgcgataatctatgctatctcctttagcctgttccggactcatatatccgtcggtcccgataatacgtccgattgttttgcctgtgctggttttcatatctttagcaatcccgaaatctataatgcagatactaccatcgggacgtaccattatattagaaggcttaatatcacgatgaatgcatcccatcctatgtatataagccattgcatccagaattttccccatcaagtcctttgcagtaaattccgtataaggtcctgccatttccacatggtgttcgatggtctctccgtctacatattccataggcaagtacatatttccatgctcatccgaaaaaggattgtcaacaatgcctaccactgaaggatgccgcatctttttcaatgcagcagcttcaatatagaaaagttctttaaactccgggttcatagtagctttactattcatcatctttattgctacacgtttcccatcgccacttctcccttcatagacgctgcccatgcctccttgacctattacttttatcaattcatattcaggcataactattttccttccttattaatattaagactaataattatattaagtaatacatcagtagagttctctccttctttctcttttccttttattacaatatctatttttttaggtggttctttctctgtaaaagagatatcaaatcctgtttccttttttgttttcttgaaataagttgcatcatattctatgtcagttatctgaaaatgacgattgagttttgaaggctgtgattgtccttcaactaaaaaacacgcattctcaccttcaataaaagaaaaggcttttcttttaggaacaaactgagcatcaactctatatgtaagagaatccacttttccagtagctgccacaatagcaacaatactaccatttgcggtattacttacatcatttacaacagagggagtagattcttgatgagtttgcttcggctgtgtcaatgtcatatcttttaccacaggaacaacaaatttgaatatcttcacagagtctgccaaagaaaaacgcaattgttcgtttttaaactcttgtcgaaacactaaaagacggttaccatatgccacatcaatatcctcatcatactttaatgaatcacttgacagagcacggtttatttctatcaccttttctttttctttgcccataaggatctccgtatgtccttgcttataatttatttctaaaatatcttcacctttctggaacttaatttcaggcaacataataattgtatcccttcgcataaaggatttatatatagtaatagattccgacttaaaatgcttattccaaaaataataacctccactggcgccaatacatatcagcaaaatgacagttaatatgatcattcctatttttcttctttgaggtttagaaggcgaaccaggagtaatagaaaactctacaatctctaccgttatattgtccaatcccccattgtcccttgctcgttgtactaaatagtccacacgttcctgtgaccccatttcagattgtctgctgacgatgcgttctatctccctatctgatatcattccgctcaatccatccgaacaaagcaaaaaacaatctccagcttcgggtaaaatcgcatcaggcagtactgtagccggtttcatattggcaatgcctaaagcatttgttatttcgtttttccgtgggtgatgttctgcctgctcattagtcagttgtcccatatccaccaacatctgtacataagagtgatccttggttagttgttttatacatctgttacgtattaggtaaacacgactatctcccacatgacctatataaactttagagtcacggaccaacaacaatacacatgtagaccccattccctgcaactcaggttgtatcattgcctgatgaagtatagccttattggcagcatcaatagcttctccaatggcttcacgaggatcttcataatactgtccgtcaagaaaaccatgaatcgcttctacagctaagcgggatgccgtagctcctccgacgtgccctcccataccgtcacatacaacagcagcaaggccattgatcgtttcgaagttgcccatactgtcttcatttgcctgacgtttgcagccaatgtcggtacgccctgcaatgtgacaatagttatatatattttcttctttcattgcctaatttgctttttattgaggaatagccaagaaaatcattttggtagctcccaaaacaataacatcattcgtatacaactgtacacggtcacctacaaatgttccattaatatatgtaccatttgatgaattctgatcagcagcccagaaaataccttcagcctctctgtaaagtatcaataaatgctgggatgacatattgctatctcctggaataggaatatctgaagtagcagcacgtcctatcacatttctcccctcatagattttgtatacttcgcccattggattctggtcgtaagaaaccagtaagcctaccaaacgacgattgtcagaagccattcctgttccacccgtaggattaacgtgacgaataacagtagcacctcccggattattttgaccacttttcccaaggtctattgtatccgtttctgcgttcatatttccacctagcacttgagttttacctgtcgttgtatcatcgtcgagtactctagttgaatgggaagaaggacaaaaaggacaattatccccataaatactcgaatcatattgatgtccgtttatacatttttttgttgccatagttattataatatttagtatgattatttaattaattccaccgctcgtttgggttgtacagcctgattgtagccttgcgacaatcctaaatatcccgaaacgataacgcccgcaaactttcctctttcgttaaatactggcgaaccgcttgccccctgatgtatcgtaatattatgcccatactgatattcgcctctttgctgagtaatctctccgctctgattattcgcttccaaaccgatctctgtatctcccaaaataaaagattgagggaaacctatagtatatactttcttgcctaactgtaactccttatccgtaacgatatcattcagatcaactatattaactactccatctggagtcttctttgtatttacctgtataattgcaatgtctatcttatcatcattactcactttacaaattgagcatgggataaagtcgtttaccgaactcacatgagtatcattcaaagcaactcctgtataaaagatattatattttactgtaacagcacgcgccaacgctaatgctcctgcattattgggataccttttcacaatagccatttgaatagtttcctttactttttccgctttttctttttctccgtccagcaacgacacaacatgtttattggtcattatcttaccatctgtagaaatgaaaaatcctgtccctgacgatccgcctactccttgacacacatcatctttatcgtccaaatagaaataattccacgaatcatctcccatatattcgcccaacaacttatcaccaacactcgctacataagcagttttttgataaatcaacacaaccgatttctggtatttttcgtagatttcttccggaggcaacgaccggtgtgtccaataataccagatacctacactcactgccaacaaaatcaaaaaggcactgccccactgccacaagtaccctcctttgggaggagtcaaagcaaatatattctcccactgcaacggatactttttagaaattagcactacatctcctttcaccaagacatgagacgaaattctgtttccattcacataagtaccgttcgtcgaattgttgtcaatgattaacacgtccccattagatcgttggcataatatagcatgttcactcgacacatcatcaaaattcaaccgaacttgagcctccgaagaacgtccgatactccgtcgatcttttacatcaggcggaataatcacctgtcccttaccagcagataccactgtcttctcaggttgctgtattattctattccaatcaatgcttgtattacccaacttcactttgtcaccatttgacaattgcacctgattttgtatacgcatgctgttaacaaaagttccatttttagaattaagatctttaatacatactataccagaactcgacacggtgatgacagcgtgctgtgatgatacgcccgggtcacttaccacaacatcattaacgggattccgcccaaccttgataactcgcatagactcttccttatttattattcgtatatttctctatatttcagtctgttacacttcaacaagcatccaaatgtagcaaattaatataataaaaaaaatcgcaaaaagtatcaattgtacctaaacggtcaaaaaaggggattattacttcaaaaaacatgcttattatgagttttttttcctatcgtaattaaagaactttttatagcggctgtctatctccgattttcatcttcaccaacactaatcgaaataccctatcaacaaaattagtttatagaatgaagtcttgattcattgacctgcccttcaaataattgccattgaatatatgtatttcaaaccatacaagaatgaatctttacctagtacagtaatgttatgataaataaggctttcttttttcatcaatctatggaaaatttaacttccatagctatagactccggtaggtttcataattgttccttcgctatcttcactcctttctatcataccgtaatcctgttaagtcatatcgtgacaaacattcctattaacatttctccatcatttcagataaaattataaaaaacattaagtttttttctatcacctatcacccaccgctccacatccatttattcatcgcacttgcagacaagatgacaagttatccgaacctatcaccacatctatcacctatcaccacttgtgtcatccaaaacattaatacttatcacctaggatattagtagataagttctactctattagaactaaacttacttttctctaatagataagttattttccacctattgaaaactataaacgcaatctctgtttttataaatgcaagcttcatttataaaaacaaagatttcatttctataattaaaacttgcatttgtagtttataagcggacaaaaacaactttactattagaggaaaggaactttgcaataggaagaaaggaacttttctattaatagacaacacgtaaacctataatagacaacgaaccaaccgatatataaaaaactttaagaaaagtacaacacaaacatttgtgaagccgaataataaagcgtacctttacatgccttccggaagaaagacattaacaataacaaattcaataattagatcattttacagacacattcattatgaaacttactttgatgcgggacaacggagggacaccaaccatgcgaacgttggacataaacctacaaatagaagcgatgaagcatgaaacgaaagcccaaccgatcagcaatctacggacaagcatacgttacgcatcaccggacgccaagctggacgacgccaagaaattgacaaaagtcatcccggctgcagcttttcgcaaaacggccaacggcatacagatgaccgcatacaacggaatcatacaaatagaagtcaatcatctggcaaacttgatggaagtgaaccgggtgaagcaggaagcggaagagctttcgcagacttatcttgctttcatgggttccagcggacattccgtaaaaatatgggtacggttcacacgaccggacaaatcacttcccaaaaaccgggaagaagcggaaatctttcaagcgcatgcctatagaaaagctgtcagcttataccagcctatactctcctattccattgaattgaaaaatccggcattagagcaattttgccggcaaacatacgacccggaactttattacaatcccgactccaccattatgtatatgcgccagccaatggaaatgccctcggaaacgacctaccaagaagccgtacaggcggaaacatcgccattcaagcgattgatcccgggatatgacagtcttgaaacattgtctgcgctcttcgaagtggctttaaacaaggcatgccaatctttaagcgaacttcagccggggatatatccccgatccgatgaagacttgaagcctttattggttcagttagccgaaaattgcttccaggcaggcataccggaagaagaaaccgcccgttgtgcaatcgctcatttatataggcagaaaaaagagtttctgatccgccagacagtacagagtgtatacaccatcgccaaaggcttcggcaaaaaatctcccctgtcggcagaacaggaactggagctgcgaacggaagaatttatgcaacgcagatacgaattccgttacaatacaatgacgacagtaacggaatatcgggaacggaatacgttttgtttctacttccgccccctgagcagccgtgttcgaaacagtatcgccatgaacgcaaggctggaaggactcagtctttgggacagggatgtggtccgttatctggactccgaccggattccgattttcaatccgatcgaagattttctcttcggactggatgtacgttgggacgggcacgaccggattcgcgaactagcagcccgggttccctgcaacaaccgacattgggcggacttgttctatcgctggtttctgaatatggtggcacattggcggcagacagaccggaaatatgcgaattgcactgtaccattgctcgtaggtccgcaggcttaccgaaagtctactttttgccggagtttacttcctcccgaattacaggcatattacacggaccgcattgatttcagtaacaaacgggatgccgagatatccctcaatcggttcgcactgatcaatatggacgaatttgaccagaacagagtgaatcaacaggcttttttgaaacatatttttcagaaaccgattgtcaatgtccgccgtccacacggtacggctacgcaagagatgcgtcgttacgcctccttcattgggacgagcaatcacaaagacctgctgacggacacttccggtagccgccgttatattgttgtcgatgtgaccggaccaatcgattgttccccaattgattacgaacagctctatgcacaggcgatgcatgatctatacaagggggaacggtattggtttgatccggaagatgagaaggtgatgaatgaaagtaaccaggagttccaggtgatgccaattgcagaacaattattccatgagtatttccgggcagctacagaaggagaagaatgcgaacaattccttgccatcgaaattctggagcaggtgcaacatgatagcaagattcgcgtatccgattgcaatattattcagttcggaagaatattacaaaagaatcgggtgccttctgtgcataccaaacgaggtaatgtgtatcgggtggtacgaattaaagcaaaaagagaataaatatatgtgtgtgccgacggtgacaggtgatagatcagtgacagatggtctgcgacctatcaccagcatacattactgatgaataaagagtttcaggaggcggtgacaggttgaaagagaaaatcaattttcattagtttccttcactttcttcccgccaataatattcagaataatgttcatagctccctttcccacgaaagaagtacctaccacgacaactttgggcaaagacttcagagcctctttcacagctgcacgctttgcttttcttttagctttgattccatttaatgaattcattccatcaatcagatagttacgcgtcacgtaaccgatacgtaaagtcatcagcgaattcacgatgccatcgcatatcgaaccgatgactactcccggaattttcacgttagacagaatgctcaaaaagccggtatctcctgaaactgtatctcctatgtcgtccaaatccacatccacatcggcaccatcggcggcagcatcggaaacgtcgatatcggacgctgcatccgaagaccggtctgccaatgagccgaagggggcaaccgaacccatatctctaaagacctccgatgcgacgaaagtcattaatgaagtaaccagaatattgacatactgccggaacaactgttgccttgtaggtcggaagccggaagcaacaatcacatcctctatcattttataattcatataaagcacggacaccgtgtccagctttccgttctgcgaaatggcggtaatcataaaaacagatttagcccattcgataacgcgacgattgatgccgatgatacggaccgaatgcatatcctctgtacgcggacctgacgtttctttcagttctcccccttcaatgcgcaatttcagctcttcgcttatgatttgcaccagttcttccttactcgttgcataacgttccaaatcttcacgcaatctctgctgatgcagttttcttaactcgggacaggacttatctttaggtatataattgcagttatccgccagtttatgtccaaacgcaacaagttgtgcagtattccactccccatcaatagacaaagccggaaactgcggagcacgatgcacccgaacgaccggacgtataacgacggcataaaatacaaccagaatcaaggtgtaaaaagcatactctgcccacgcaacctgcgataaggaggctattttctcaccaataataatgatgttacccaacaataaaatcacaaaagagcccaaaaacaggagtgtgataattaataaatttcgtttcattggcttattcttatcttattgaatccttaaaactctgaacttgtgcatttattgaccgaagcaacgcatccttcctgtcaaattcttctttatcagacaccagcgcattcagatacattgttttttgttgttccaaaaaatcaatgatactttgtttgcgtacaggcacatactgatcataaaggtcattagccgccttatatatactcttcccgacagtcagctgaagatatcctttgatcgttttcccggtatgcgtatgatcgattccggtgatacattccatcgcttttctcagaaaactctgaatttccattgtcgaataagtcccgaacggattgggtattccgatatgcggaacagtcggattattaatattcttcacatcaaaagctccctgcaaatcaaaatcgaccaccggaaaatccgtcacttgcggcactgagtcaaaaggtgcacaacctttctgcttcagaaaagtattcatcttctctataaaagccacatcatctttcaagttagagagtttccgcaaatactgccgggccaggctatgttcatgggaatcaaggaacttactttttatcgccgctgacgaatcagtcataaactttgtaacaaggctgcgtgtcgcatctttccccttcgctccaccggcaaatgcggaattgcatccggaatcataatactccctaacgatttcagtaaactctttcaaatcatcatccatatagacttgcaccatttttctaaaatcgctcccatcgtaactaagttcactcgcctgacggagtaactcgtcaaacgaagttgccgcagcctgatattctatatcgattgcttcctgttggccaattgattctccgactaaattatccagtttttccaactgattcagcgttcttccgattacgcttctcagacgtatatcagtactattggagatcaccttgccatacaaatccttctcaaatctctgaaatttcgcagcttcttcctgaagatcctccattccctcatagctggcagcatccgccacttttcccaagttcaaactatatatattctccttcaactggaagttacgtctgcccatttcattctcggcaaattctacctgtgccttaattacagcctgcttctcctcttccgaatgccagtaagccgcttcaaacacattatgtagaagacaaaccggaactttcggattattctcctgcagcaacttcagaaaacgattggaaaccttcgatatagcagaatttgaactttgcacaaatatcacgaaatctgccctttgagagatcgtttcataaataggattatccaaattcacatacccgccatccagcccgggcatatccaccagaaatatattatctttcaaaagctccccaccggaagttgttatggatgtcaccagcgtatgatctgtatttatcacgctttcttccaaagctaacgaaacacactcctccagattagcatcattcaattctttcttttcaatgcttatctcggaaatgttttccagtttttcaaatccgcgcaggctatcaatgaccgaatcaaactgttctacctttctagctttatcagcaacagaaaaaatacgggtaatggattcctcctgtccttttgaaataatggacggacgcaccgtacactccaagaaatgagtggggctgacgtgagcatgtgctatgagatttactaaagtagattttcccgatttcacgggtccaaccactaatataagaaaagatcctccgtcaaactcagaaacacgattgtttagtttctgagttgatttacaaacagcctccaaatcttttattccccttactgactccagagttgacatcaattccttagatctgctcttcagtatattcaagaatatcttaagctccgacgaagacattgtttccactctttcttctataaatttgtatttacccataaacgagatttaaataatggtacaaccgactattcacatgtcattataataatgatgataaagttagcagtttgtcgggaaataaaaaatgtatagagcacaaagattgcataataattgaaagttcgtcaaagttttatggattcaagttcaatttatcaacaaaaagtttcttcatatccgcaaaaaacaagatgttaaaaaccgaaaaagcatgcagtcttttcggtttctattcatcatattaaaataatacacgcacatggatataaaagaacttgtagatttatgtaaaaaagggaatgagcaggcattaagtctactttataaaacctattcgaaaaagatgatgagaatatgccttcattatatacctgataaacaaatcgcacaagatctcctacacgacggattcattgtcattttcacttcgattgagacattacgtacccccgaaaaactggaaagctggatgggaataattatgaagaatatttcattaaggtatctcaaccaaaagagtacaaactctgcaattcccttatctgatatccctgaagacgaggagcctattgataatccgctatcatctgattctattccttatgataaaataacagaaatggtagagaaattgccagaaggatacagcaaaatcttcaagttagctgtattggaaggattatctcacaaggaaataggtaaactgttgaatatagctccccactcctcctcttctcaattattcagggcaaaagtcttacttaaaaagatgatttctgattacaggctgattcttatactagtgattttattttttttcccaacgatacacgactatctatactggaaaagaaaagagactaaagataatcattggtctaacaatgtcattcggaaagtgaaattagataagaaagaagaaaatgagagcattacctcttccggacatatctctcactacaaagaagaccccccttttaatactactttagcaaacctcccccggttagcattagacacaagtgcaacaggattatctaccacttctgaaataaaagactcagtagagaaacagcctgttgccaaaccatcttttacatgggagcatgcagagaaaattattacattctcatattcaagccaagaattcacttcactccccaaaaagaaaatagggaaatggaaaatgatgttggcagggtcagtcggaccacaactggcacaaaacctatacaagttgatgacaacaccacactctgacggtttggaaagcggtctcccccagcaagtcaatacttgggaagaatattatgactatttaaacacccgcaatcaggaaggaaccttaggagactcgcttacgctaatgacaattgccaagaacaacagtggaagaattatagaacatcaacaccataatagccccatcactatcggactagcattgaacaaaaagttgaataaccactggagtatagaaaccggattacaatatatttatttaaaatcagagttcaccacaggaaaggaatatcggattcagaaaacccagaagctccattacataggtattcctctccgtatttcctaccgttttgggaattataaacaattctcattttactcaacagccggtttacaaatggaaatcccgataaaaggaactctgcatacttctcatgtcacagatagtgtccccattaatttgggttaccagtcattagatgtacctttgcaatggtcaatcaatgcgagtacaggtgtacaataccactttacacctcacaccagcatctatatagagccaaccattaattactatattcccgatggaagttcattgcgcacaatccgaaaagaacatccggttacgttctctgttcctgtaggcattcgtttctcttggtaaaaaattcattctccatgcagtcttccggctgatagtttatcataactatagaacagttagaaacaatagacaaatcagatgcagaaacgacatacaaaccgtgaacgttattttgaggaacaagctcagactacgagaaattattatattccttatattaaagaatatactggaaatctgccaaacaaagtattggaagtagggtgtggcgaaggagggaatctgcttccctttgccgagctaggttgtgatgtcattggaattgatattgccgcatcccgaattgaacaggcacaaaacttcttcatcactaaaaggcaaaaaggaactttcatcgcttctgatatcttcttattaaaagatctacagaaacatttcccgcttattctcatacatgatgtaatagaacatatcgacaacaaggagcaatttctgcgcaacttaaaaaaatatctatcgcctaacggaatgatcttcattgcttttcctgcctggcaaatgccattcggcggacatcagcaaattgcaagaagtaagattatctctcatatgccatttatacatttactacctcgtatgttgtataaacggatattggaattattcagcgaacaagaaagcacagtcaaagagttattaactatcaaatacacccgatgtacaatagaaatgtttcgaagagtagtaaaacagactgattatcaaatcgtcaatgaacagttatactttattaacccacactacaaaattaaatttggactaacccctcacaaattaaacaaaacaatagcatgtatacctttcattagaaatgtattcagtacaagttgtttctatttaataagaccaacatagcattttatttcattatttacattaatattcaggaagttatcaacaggctaactataaaagacaaacagcattatcaatcatacaaagcacacaaaagtcatattttgttctttattgaacagtatttttccaaaactataaaagggctgcgttaaatttgcatctgaaaaagtacgttaacattttaaattctaaaaagcatgcatttatctaacacattgccccataataatcgtatagaaatagctgatgtgctacgtgggttcgctgtaatgggaattacacttatccattttatcgaacggtttagcctcaatagctttccggaagagacctgtaactttctgatatttacggatagggtaatttgggatagtgtatttttcaccttttccggtaaggcatactgcatctttgcattgctttttggatttagtttttttattcaagacaattcacaaaaacttaaagggaaagattttcgtgggcggtttgcctggcgattagtattacttctttttatagcttgtattaattcggctttatttccgggtgaaatattggtactctacgccttgcttggttatgtactgatcgcagtctgccgactctctacccgaacagtcacgatcatagcagtcattcttctacttcaacctattgaattgggacaaataatttatgcacttatcaaccccgactatgttattaatgctgatcttgatgctccatactgggagttagtcaatacagctcagaaagaaggttctttcctcgaaatgtgcaaaactgccatatggacgggtaatgttgccaacatgggttggatgctattacacggaagagttactcaaaccgccggtctgtttatggtaggtatgataattgggcgtagcaacgcgtttctctattcagaaaagaatataaaaatctggattaaagtattcatcatagccgttaccgcctttttccccatttatggtttgataaatatactccccgactttataagtcgcgaagcactacttgtaccttctgtccttctatgcaagtcactgtcaaatattgtatttacaggaatcatgtttgcaggtatcatactggtttattacctgacaacccttaagaatgttcttcataaatttgcaccttatggacgcatgagcttgaccaactacctgtcacaatctttaatcggagggttcttgttttacaactggggattaggactttatctgcatacaggcattacagcgtgtatccttattggtgtaagcgtattctttttacaatactttttttgtaactggtggcttcgttcacatcgccagggtccattagaatggctatggaagaaagcaacctggataaaggtaggcaagggataaatgatgctgagagataagaaaaggtgcaattcacttttacgatgaattgcacctttttagtatttttgctgcaaataacacagtctatagaaaatatcgaaaaccttctggtagtgcacattagaaagaaataccctataacaaaaaagctaagtaattgattgctcaattcttagcttttcgtggtacccagacccggggtcgaaccgggatggaagtgaatccactggtgtttgagaccagcgcgtctaccgattccgccatctgggcatgcttgatttctcaattgcggtgcaaagatacgacaatattttgattccacaatagtttgagaaaaaaaaggagcaaaaaataataaaacatgtcccaaaggcttctgtatttagagaataaaccgtacattagcaaaaacatttaaaaatagagtcactatcatgacaaacatggataattattgcgtgattatgggtggtggtatcggtagccgcttctggccgtttagccgcaaaacattgcccaaacaatttcttgacttcttcggaaccggtcgttcactcctacaacagaccttcgaccgctttcaaaaggtaatcccaaccgaaaatattcttattgtcaccaatgcaatgtacgccgatctggtgaaggaacaacttcccgaattggatgagaaacagattttattggaacccgcaagaagaaataccgctccatgcatcgcatgggctgcctatcacatccgcgctttaaacccgaatgcgaatatcgtcgttgctccctcagatcatctgattttgaaagaagaagaattccgtgccgcaatcattaaaggactggaattcgtttctcactctgaaaagttactgacactaggcatcaagcccaaccgtcctgagaccggatatggctatatacaaattgacgaaccaaccggtgatggcttctacaaagtaaagacattcaccgaaaaaccggaactggaattagccaaagtattcgtagaaagcggtgaattttactggaactccggattatttatgtggaacgtcaataccattattaaagctgcagaaatcctgcttcccgaattagtatccaaactggcaccgggaaaaaatatctatgctacagataaagagaaagcattcattgaagaaaactttcccgcatgtcccaatgtatccattgacttcggcatcatggaaaaagcggacaatgtatatgtatctttaggcgattttggctggtctgacctgggcacatggggatcactctacgacttatcagaaagagaccgggaaggcaatgtgaccttaaaaagtcattctttgatctataatggaaaagataatatgatcgtactccccaaaggaaagctcgccgtgatcgatggcttggaaggctatctgatagccgaatcggacaatgtcctgctaatctgccgtaaagacgaagaacattctatccgcaaatacgtgaatgatgcccagatgcaactgggagacgatttcatttaagaatgaagaactaaaaaaagaagaatgaagaattgctatgcagcatacagcgcagctaattcttcattcttcttttttaattctttatttaaataatttctattccctgctccttacaaagctgcaatccaagatctttcagtctgaatttctgaattttaccactgcctgtcatcgggaactccttcacaaaaaagacatatttcggtatcttataacgggaaatcttattcttacagaagtcacgaacgtccgactcatgcatttccaccccttcctgcaagatgataaaagcaccaaccgcttcaccatatttcttagagggaatccctgctacctgaacatcctttactccatcaagtttataaaggaattcttcgatttcacgtggatagatattttcaccaccacgaataatcatatccttgatacgccctgtgatccggtaatttccgtcctcatctttaatgcctaagtcgcccgaatgcaggaagttatctttatcaatcacttcagccgtagcttccggattcttataataccctttcatcgtattatatccacgattgcacatttcgccttgtacgcctaccggacattcttcgccggtttcaggatcaatcactctgacttctgtaaattcaaagtcgcgtcctaccgtattacaacgtacatcaaacgaatcatcgatgcgggtagcggtcataccgggagcggcttcagtcagtccgtatacactggtaaccttcatgtacatcttttcttctacctgtttcatcagttcaaccggacacaacgaacctgccattataccggtacgcagacaagacatatcaaacaagtcgaacatcggatgatgcaactcggcaataaacatcgtaggcactccgtaaagagccgtacagcgttctttatgaatggaagccaacacgaccaacggatcaaaccgctctaccatcacctgtgtacacccatgagtcagacagttcatcgtagccaacaccactccaaaacaatggaatagcggcacacaacaacagagtttgtcatccgccgtaaacttcatgtgttcgccggtcagaaaaccgttgttggcaatattataatgagtcagcatcactcctttcgggaaaccggtagttcctgatgtatattgcatatttaccacatcatgacagtccactttacttttaagttcagtcaggcggtcatcttccacattattccccagcagcaagatttccgcagtattatacattccccgatgtttctcctgaccgacgtatatcacattcttcatatacggaaagcgttcactcttcaaatgaccgcgttcgcaggttttcagttcaggaagcatcgtatacgtcatttgcacaaaatcactgtccttttcaccattgacgatacaaagtgtatgcatatcggaattctggcagagatactccagctcggcctgcttataattcgtattcaccgtgacgtataccgcaccaatcttggcacaagcatacagcaatgtcagccaatcgggcacgttcgccgcccaaataccgacatgagtaccacgttccacaccaacagcgatcagtcctttcgccatatcatccacacgctggttaagctggctccatgtaaaacgaagattacggtcggaataaacgatatattccttatcgggagtctcttcagcccaatgttccagccattgcccaagagtacgttcaaataattgcatgcgattattcttaatatttggtatcagattttattaaatcggagtgtagactacagccaatattttagcagcctgcccttcgtaagcatgtacatgatgaggaacgatggagtcatagtaaatactatcaccttcttccagcaaataggtattcttaccatagctgatttccataaccccttccataaccatgataaactcttctccttcatgcgaagaaagcacaaagtcgctgtcctctgtcggcatcacgtcaatgataaacggctccatgtgacgatccgctttcgatttagacaatgaatgatattccatgtgcttgcgtgaatgaatcgcattattggaaaagctgatggcatctttagcctcttttttacggcataccacaggcccgatttcatcctgatcatccaggaaagtgcccagacgtacccccagcacacgcgctattttaatcagcggtgcaagagacggtatatcgatgttattttcaattcgttcgatctgctcgatagccaaacccgaacgctgtgccaattcctctatacttattgatttatcttcccggagcgctttaattttctctccaacaatcttactcgtatccatattgaaagttttttagttagcaaaggtgataaattagaataattaggttgcaaaaatagcaaaatctttagatgaacacaattataatcctaaaatatctcccataatatatctcttttcacctacctgccttgaaaatggattaagtaatatatagactggagattaacactaattaaactcggaattttcatattttcattattttttcctttcttgcataatcatagatcataagtagttattgttaagcctctaaaatatatagcttatgaacacacacaatcaattcacaagtagtaaggaaagaatccatttactattagtattattcctctcaatcattttttgcagttgtacgaaggaagacagccctgttagtatagaagcgaccagtaaagtggtaacaacaagaacgagccaggacgagtattttgagcatgcaaaattacctcagattattaaaatagaatggagtcaatatattccatttccacctttgctaaatattcagatacgacaaggtcaagggaaatatgatcagattcaattaggagcaagtcgtgattttgatcctaatccagttgaatattccttctttcctgtccgtgaagttttggttcaagaaggaacctatgaaacaatccaaatacctgtaaccgatctacaacttcccgaaggaggaggatatattgcggttcgtgctacctgctcagagttagtgtatgatcgaccatatcctgataaaggcccatggaatccctatgcaaacttcgtcggatatgattttgataagcaagagtacactttctctaaagttaattcaatgtatggttctatttgttttcgttttccacccgatatacctttccctatggcatgcgatgtactcattacaggcagtggttattgggaacccattacggtctctgcagtctatgatccttggaataaagactcccctattcaatggggatacttttcttatgatacaaaaggagatgaagtatcatttgcttatcgcacaaattattccaactccagtcattacgatggctcaactgttcatttcgcaacagttagtaatcaaacaagtatagttatgctaacacttgacgttccccaaccttcaagttactgatcattcaaaatgtaatgagaatacgctccataatcatcactttctgcctcctatcaagtatagccgtgcaaatccatagccagcaagttgcggattctatattcgcaacttactttgcccgttctcaagcctacgccgatgcatatccacgcgagaaagcctatctgcacttggacaacaccagttactacatcggagacacgatatggtataaggcatacgtagtaacggccgagcaaaaccaacctagcccaattagtacccccctttatgttgagctattagaccaactgggaaatactagtgaacggcaaatcatacagttgcgggatggagaaggagaaggacaattcatactgacaaaagccttattctccggtttttacgagatcagggcttatacgaaatggatgttggcattcagtgaaaagcaatatttctcgcgtacgatccctgtatatagaaaacggagaagcgaagtagacgaaaaccggagcatcatcacttaccgaatggatgaatctatgaagcaacgtccgcgttcaaaagaaaaagatttcatgattcgattcttcccggaaggtggacaattagtagagggagtaccttcagtcgttgcattcgaagcgacaagtaaagaagaaggtacagtaggcatttcaggaactgtttatgggccggatgatgtagaacttgcacaatttacaactctccacgacggtatgggatgctttacatacacccctacagacaaacaagccaaagctgtagtgacctatcaagataaaaaatactcatttcagctaccgaaggctttaccccaaggatatgtgctaaatgtgacgtctaaagaaaaagcattagtcatcaaagttctcagaaattcgacaagtctcaaagatacactggctttattcatatcacatcaaggacgtccgctcatgtatcagacccttgattttaaagatcaaacagtatatcatctcccgttatccactcagggattgccgggaggagtcatacaactctctttaatgaatagcaatggggcaacgttatgcgagcgtttttgctatgtgatgccttctccatctttacagttaacagccacatccaccaatgcattatactatccttttgaaccaattgagtatcatatctcaatgaaaaaccatacaggtcaaccaatacaaggacatttctccgtagcggttcgggatgctttaaaatcagacttccaacggttcgatcagacaatttacacagaccttttacttacatcagatctgaaaggatacattcatcaacctggatattatttcgcaaacaattctcccagacgaagagtggcattagatattctgttgatgattcacggatggagaaaatatgatataagccaagccatcagtgccactccagaaacaccaatctatctgccggaaacgagactgactctacatggacaggtaacatcttttctgagaaacaaagaacaaaaagagatctctgtaagcgtcattgcccggagagatacgatatcagcagcaggtactacggtcacagactctttgggattcttccaaattccaatggatgccttcaatggttccatgagtgcggctattcaaactcgccgtaaaggaaaaaagctgaaccggaaaacaaacatatcacttttccgcaactttacacccgaactacgcaaatacgcttacgaagagctacatcctaaatgggaagatattagcggactcagttggtggagcagtctctccgactctctttatctagattcaattatgggacacgatactcatttgttggatcaggtaacgattaaagccaaacgtacgaaatacaaaaaaattctagctttcgagcaatctgtaagagcttattatgatatccctaaggaactggatcgaatgcgcgatgaaggaaaattcatggactatttcccttggctaatgaccacattaaatcccaatattcaagtgaagtctaagtggaagggagatccaccatttataaccatgaaatacaagaatcattatatactatgcgtcataaatggagttctttactcaacatttgatcgggagctttttatagataaaaatatcgatgcgataaaatctgttatgatttgcgacggcacgacagcaagtgccggaattgatgacgacagcgcttatcacctgagcgacgaaagtctaaaaaatcacatggaaacttccagactctctccctttgaagaaaaagctctcaaaagttatctgaacaacacaactcccaataatcaaccgggaaatcaatttgcaatttgctatatcactaccatcgacaattgggacccggaaaagaagtaccaatcacgtggtatccgaaacacacagatccaaggttactcccagcccattgaattttattcaccctattacccggatatcagtaaaggacaaggcaatgaccaccgccgtacaatctattggaaccctaaagttaccaccgacgaaaatggagtagccatcattcgctgtaataatgcgaactcgtctacattcctgacaattagttgtgaagcactatacaacggacagccggctgcaatcaatatgcacagcataaaatactaatccttcattgaaagccaataaaaaaaccgttctcaatgtgagaaacggtttttaatcttttcgcggcaagtagattacttacgcaaaccaagttctttaacaatagaacgatatcttgtgatatctttgtccttcaggtaattcagcaaacggcgacgtttagctaccaacattgttaaagctctctctgtactataatcttttctgttgagcttcatgtgctcagtcaggtgagaaatacggtaggaaaacaaagctatctgcgcttcagttgagccagtatcagagttagacttcccgtactttccaaagatttcttgcttttcagctgcgtctaaatacataatttttagaattttgatatagtaaattattcttttgagcgtgcaaagatagacattatctttatatctcacaacgttttacaagaaaaaatggggctattgcatttatttctaatcctattttcgtacctttgcagccaaataataggtattatatgcaaaatattcgaaacattgcaatcattgcccatgttgaccatgggaaaacaacgctggttgacaagatgttgctggccggaaatctattccgcagcaatcaaaatagtggtgaacttatcctggataacaacgacctggaacgtgaacgtggtataacgatcctttctaaaaatgtatccatcaattacaacggtactaaaattaacatcattgatactccgggacacagcgacttcggtggtgaagtagaacgcgtattgaatatggcagatggctgcattctgttagtcgacgctttcgaaggtccgatgccccaaacacgtttcgtacttcagaaggcactggaaatcggtttgaaaccaatcgtggtagtaaataaggtagataagcctaactgccgccctgaagaagtttacgaaatggttttcgacctgatgttcagcctcaacgcaacagaagaccaactggacttccccgttatttacggttccgccaaaaataactggatgagcacagactggcaaaagccgacagataccattaccccgctactggattgtattattgaaaatattcctgctcccgaacaactggaaggtactccgcagatgctgattacttctctggattattcttcttataccggtcgtattgccgtaggtcgcgtacatcgcggtaccttgaaagaaggaatgaacatcacgctggtaaaacgtaatggcgatatgttcaaatctaaaattaaagagcttcatgtatttgaaggtttgggacgtgtaaaaacaaacgaagtttcatcaggagatatctgtgcattggtaggtatcgagggttttgagatcggagatacggtctgcgatttcgaaaatccggaagcattaccgccaatcgctatcgacgagccgacgatgagcatgctatttgccatcaatgactctccattcttcggaaaagacggtaagttcgtgacttcacgccacatccacgaccgtctgatgaaagaacttgataagaatctggcactccgtgtaagaaagagtgaggaagacggcaaatggattgtttccggccgtggcgtacttcacctttctgtattgatcgagaccatgcgtcgtgaaggatacgaactgcaggtaggtcagccacaggttatctttaaagaaatcgacggcgtcaagtgcgaaccgatcgaagaactgacaatcaacgtaccggaagaatattcaagcaagatcatcgatatggttacccgccgcaaaggtgaaatggtgaagatggaaaatacaggcgaacgtatcaaccttgaattcgacatgccttcacgtggtatcatcggtcttcgtaccaacgtactgaccgcttctgccggtgaagctatcatggcacaccgttttaaagaatatcagccgcacaagggagaaatcgaacgccgtaccaatggctccatgatcgcaatggaaagcggaactgcttttgcctatgccatcgataaattgcaggatcgcggtaagttcttcatcttcccgcaggacgaagtatatgcaggccaggtagtaggagaacactcccatgacaacgatctggttatcaacgttacaaaatccaaaaagcttaccaacatgcgtgcttccggatctgatgacaaagttcgtctgattccgcctgttcagttctcactcgaagaggcattggaatacatcaaagaagatgaatacgtagaggtaactccgaaagcaatgcgtatgcgcaaagtcattctggacgaaatcgagcgtaaacgcgcgaacaaatcataagcaatagcccgagataatgcagaaagcccgccggattttatttagcgggctttttctatttccagttcatgcatattaagcaacttctttacgatccagtagccaaccctagctttataaaaagtttttttaatacaagatcacccccaccagacctgccagacaaatcagcagaataggatgcaaatcccatttccaggtgataaggaatgccccagcaaagattcctatacttttataatcaataaaattctccctgttcatcatcaacaaggcagccgaggcaatcaatgccactgacatgggaagcaagccggacatcgctgcttttatgtatttattatccttgcatttcgcaaagaaataggaaatgagcaatacgagaataaaagagggcagacacaccgctacggtagcaagtaccgctccccatacactgtgtgtcactgcatagcccacataagtagcactattaattccaatcggccccggagtcatctgcgaaattgccaccacatccgtaaattgttggggagtcagccaatggtggagatctacaatttcatgctgaatcaacgaaagcatcgcataaccacctccgaaaccaaacgtacctatcttcagatacacccaaagtaactgtaaatatatcatgcctttatatctttaatcttatttttcaaccacagagtatacactaatccaccggaaatccccgccaataccacataaataggagaaagcccgaattgccagatcagtactgtggcaatcacaggagctatcagttgcacatacttcaaatgcaaagctctgaccgcagatatacaaggaaacaaaatcagcgccactacagccggacgtatcccgttaaagatacgaatcatcacctcattgtcctgaaaacgggcaaagaacatggcaatcaacatcataatgacgaatgaagggagaatagtcgccaacgcacaaaccagacttccgctgaccttatgaagtttatatcccacgaaaatggatatatttaccgcaaaaactccgggcaacgattgagtcaaggcaaacatttccataaattcttccttgctcatccattttctcttgactatttcccgctctatcaagggaatcatggcatatcctccgccaatggtaaacatgccgatttttgcgaatgtacaaaagagtttcaaataagtaataatcatgtatttgtcagcgttttatcgaacataattcagattaacaaagatacaaaatcaccttcatataaacaaaaaaaggcggctcctttcggaaccgcccacattttgcattacatatctattgcctaaaaggcttagagtttcggaccagcagcaactaaagccttaccagcttcgttacctgtaaatttagcgaagttcttgatgaaacgtccagccaaatcttttgctttttcttcccattggcaagcacattcgtaagtgtcgcgtgggtcaaggatcttcggatcaacacccggaagttctgtaggaacaacaaagtcgaagtaaggcataaccttagtaggagctttgtcgatagaaccgtcaaggatagcgtcgatgataccacgagtatctttgatagagatacgtttgccagtaccattccaaccagtgttaaccaagtatgccttagcaccagttttttccatcttcttcaccagttcttcaccgtatttagttgggtgcagtgacaagaaagcagcaccgaaacaagccgagaatgtcggagtcggttcagtgataccacgttctgtaccagccaatttagctgtaaaaccagacaagaagtaatatttagtttgttctgcgttcaggatagataccggaggcaatacaccgaatgcgtcagctgacaagaagataacttgtttagcatgaggacctttagacaccggtttaacgatgttttcgatgtgatagataggataagaaacacgagtgttttcagttactgacttgtcagcgaagttgatttcgccttcagcgttaactgtacagttttccaacaaagcatcgcgtttgatagcattccagatgtccggttcgctttctttatccaagttgataactttagcgtagcaaccaccttcgaagttgaatacaccttcgtcatcccatccgtgttcgtcatcaccgatcaacaaacgtttcgggtcagtagacaaagtagtcttacctgtacctgacagaccgaagaagatagctgagctcttgccttctttatcagtgttagcagagcagtgcatagaagccataccgttcaaaggcaataagtagttcatgtaagagaacatacctttcttcatttcaccaccgtaccaagtattcaggataacctggatcttttcagtcaagttgaatacaactgcagtttccgagttcaagcccagttctttgtagttttcaactttagctttagaagcgttcatgataacgaaatcaggttcaccgaagttagccagttcttcagctgtcggacggatgaacatgtttgttacgaagtgagcttgccatgccacttccatgatgaagcgcagtttcaagcgagagttttcgttagctccgcagaaagcgtcaacaacgaacagtcttttgttagaaagttctttagttgccaaatctttcacagctgcccaacatttagcgtcaactggtttgttgtcgtttttgtattcttcagaagtccaccatactgtattttcgctggtttcgtcttttacgaagaatttatctttaggagaacgtcctgtataaacgccagtcattacgtttacagcgcccatgttagttacctggcctttttcaaaaccttccaaacctggttttgtttcttcagcgaacaaaacgtcataagacggattgtgcacaatctcggtcacacctgtgataccgtacttgcttaaatctaaatttgccattttttttgaattaattaaaattggtatttcgttttattatctcttttcacctgaacatgaggagctttgggtgcctccttgtaaatccgggtacaaaagtaatactttctttgaaaaggaagaagggattagagaaatttttccctaattgaatctcttttataaattcctaacaatatctgcaaactgaatattgcaatttgaaagattatcgtttactttgcaagccagaacgttctcaatacgatgaaaatgagattaaattatgattaaactataatatgaaagtaattgattttagccaaacaaattcgattctaaaccagtacatatccgaaatcagaaatgtagaagttcagaatgaccgcctacgtttccgccgtaacattgaacggatcggagaaatcatggcttacgaaatgagcaaagagttccgatactcagtaaaaaacatccggacaccactgggcattgctcccgtcagcacaccggacaaccagcttgtcatcagcaccattctccgcgccggccttccttttcaccaaggcttcctaagctatttcgacggagcagaaaatgcatttgtgtccgcctatcgaaaatataaagataccctgaaatttgatatacatatagaatatatcgcatctccgcgtattgacgacaaaacgctgattatcaccgatccgatgctggctacaggcggcagtatggaactgagttatcaggccatgcttaccaaaggccatcccgccgaaattcacgtagcttcgatcattgccagccaacatgcaatcgatcatatcaagagcgtatttcccgaagacaaaacaaccatttggtgtgctgccatcgatcctgaaatcaatgaacattcctatattgtaccggggctgggcgacgcaggcgatctggcttatggagaaaaagagtaatatcgattaaagattccttcgatattgctgcggcgacatccccatttgcttcttgaagaatgtgccaaaataagaagcattggggaagccgaattcattggaaatctcctgaatatttttttgcgtattcttcaacaaagagatacacttacggataatcgccttgaatacaagttcctgcaccgtatacccacagatgcttttggaaagagccgaaaggtatttcggagacaaacagagtttatccgcatagaattccacactcctttcctgcatataatattgctctatcaactggatgagacggacaaatatctcatttttccgcccgcccgtttcctgtccggcactaatcaatttacggttatagaccgaacaaatacgataggtcagtgccagcagaaggagtttctgctcataaaggctaaacacactctcctccatttccagcacactgtctatcaaagacatatacttcataatctcatcttcctcgccggtattccatacacaagagagttccggagtaagtttcgaatacatatacatggaaaccacggagttgccgataatgtcacgtatcggttctatctgataggcaagaataagaatttccacatcttcggtctcctgaagcacttgaacccaagattcctcatgaataaacaaggtctcacccgccttggcagaagcgcacttattatcaagagaaaactggaaactaccttgccggcagacaatcaaaccaagcccctgcatcagaaaaggttcttttaaagaagatggaaaacaactgagcacacctcccgaactgcatatattcttcccgcttttcagatcgcggtcaagctgtaataaacgttcctgctgagtatccataacactgactcactgataaattactattgaaaaacgatactaagttagcaattttcgtttgggataaggcactacgagcacaaaaatcatacaaataacgcctgcataaatagtccaccctgccatttctttcacagcagagagcgtagcctgcacctgtatccgccccttgacggacatggcagccatgttatgcgcttccgtttcactctttccctgatattgcattccctgcacggtattggtatacgaagcagaagcttcggggtttaccagatcaacattttgtgcataacgggtaatataatgttgctggcgctcctgcagtacatttgaataaatagcccctccgatacccggtcccagtaccatacggacggtaagcatgatgcaaatccaggtcgaaagatatttgaaaggcatccgctgattggcatatgctgccgtcaatgcatataaaatcatcattccgatggtacgaataattacgggatacttcattcgttcgtaaagtccggctgtctgcacttcgaagtacatgaatcctgccgacaatgccagaaagaaaaagccaagagcaaaaagatatttcagatgcacccctttagaccccaatacaatggaaatcaaggcaccgataaaataaccgaccatacaccagtttgccagcgatgcattctgcaaattatccaggtgcatcccgactcctgcatacacattgacaaacattgcgctggaattgataatcatcagcaataaataaagcaaagcccccatacgaatggtacgcagcctcaacgcccccaaaataaagtaggaagaccgccgggtaacatccatataaagaaaaatcccggcaaaaaggatactgatcgccgttgcccagcaaatagatggatcatcataccaatccagcaccttgccataaaccagcacataagtgatgcacgtcaatgatatgcaaaatgcggtcacattgccgaatttgcggaagttgatagggaaacgtccggcaaaaccatgattaggcatcgtaatgaacagtatcagaatggacagcagcagaatacccatcataaaataatatacatatttccattcgtattcgaaagccagccaagccgttagcgccgtacccatttgccccaggatcataaaaaacagataaactaccggctggctgatacatttttcgatatccagtttattccatcccgtcgcgtctttcggttccatgccgggagtaatattacgcgttgcctccatgccaaaagcatatttgatcagcgtaaacagattgaccatcatcagtaccatacgcaggaaccctgtcagcaggctgcagagtgccagcaaaaagatactgtcggttttggcacatacatagctgaatacatacatcagtgcaaaacctgcgatacacatcagtttctcccgtcgtatacaaactagttcatacaagaagggagcaaatgccgccataccgatggaagtcacaaaattggcaaactgaatatgctcggaaataatacccaagccgctcatcatctcggtactgttcacggagtataccccgcccaccgaaagaatcggcaggaaaaagaacagcagaataataatacctatcggtttgggcacccaattgtaaaaaggataatttctaggacacgaaggcatggctatcagagtttagcttttactactaccatcatacccgccgccagcttatcattatcttccttcgataaatccgtaaaatcaatacggacagggatacgctgctgtattttcacaaagtttccggcagaattgtcagtcggcaccaacgaatatttagaacctgtcgctccggaaatagcagtcactttgcctgtaaactctttcttactgatagcatctaccgtgatagccacctcctgcccgatgcggagattctctatctgcgtttctttataattagcaataatccatttttgtgtatcgggcagaatatatgtaatgcattgccctgctgtaatgaactgcccttcttccagagaacgtctgcctaacttgccatcgcaaggagccagtacaaccgtatacgaaagattcagccgtgccatttcaagcgcagccgtagcacgctggatggcagcttccgtattctcacgacggtgagatacttcattcactcccgaaagagccgcctcccgctggcgcctggttgcttccagcttcttaaaggtagcttcatactctgttgtaatctgttccaactggataggtgtcgccgcatttcgtttgaccaaattttcataccgctgacggtctttctccagttttgctagccggatttctatttcagctatagacgcatcatacacagatgcagtcgtttgtgtagtctgcaaggtagcatttatcacagtggcgcctgcctgcgcatccttcaatgcagcctcagcttccatcacccggattttatattcgcggtcgtccagcaccagcaaggtatcacctttacgtacctgctgatgttccgtaaaataaatcttattaatatagcccgatgcacgcagattgacaggtgacacatattgctctatctgcgcatcattgctggtttccgtctgcttatagcccagaaagagaaaaacaatttcaattactccccaaacaatcacagcaactccaaacagacttactataatctgccagcggcgtaattttctcattttcttagctttctcctgatgcgtactggagattgtattattgtccattgtttccatatgaatgattcaattagttatctgttatttgaacaaggatgagatctgtccggttagtttcagtaacatcaggttggtcacccgataattataatgtgcactaatgtagttgttctgtgcctcgctcatccgcatttcatcctgcagaacttcagtcattgaagtgattccttcccgatagcggtcggtagtaaccgtatacacttcttcggcaagcagataattgtctttctgttttttaaagttccgctggttattcatcaagtcatttacagcattcaaatactgtgtttgcagattcttccgtgtatccaaccgtgaaagtttcatggtttcgatatcgatcattgctttccggatcttatacttcttatccaaaccatcaaaaataggaatacgcaaagtcagtcccaccccataagaacggaaccaatgattggacggaccggaatgaaaccaatgataagcctcatcagtataagcggcaaacctccagtttcccgtcagattgagagaaggaatatagccattacttatcaatcgtttctgccgctctgccagctgcacctgtgattgaagcaactgaagctcatagaggttttccgacaacccggtcaaagcaaccgtagcgatactatccgtattgaccggcaacaggccgatttctttttctgccggataatccatgatgtacttcagcatattaagctgctgcgtcatcatcgcctgcgcattgtcatactgtactttcagattttccagattgatattcacccgcttcaagtcaacttccattgccattccattatcaaagaaagcctgtgtgatatctctcagttcttccaatcgggtgatattggcttttatcaatgcaatctgttccgcagtaacctgtcccagatagtacattttactgatctgcaagatcaaatcttcccgtgccttttcatacgaaagccggctcatctcatccacaatctctgctatggaaatcgaagtatagagagtctgattataaagtggcatctgcaattctatcccggcattggcactatattgcaacgttcgggtaatattataaggtactccataggaagaaccgtcagttactgagacaggcggatcgatattatcattaaagttggcaaagccattgatttgcggcaacagcttcacccgattctccgaaatgccatacttacttttctgcatcgcttttcgttttccctgtaaagagagattgttctcaatccctatacgaaggcagttctccagagtcagaatattctgtgcgcctccatgaatggcaaggaggcaaaaaaaggtaaaaatgaacaatagtcttttcataataatcgctctatattcaggcacaaatttaatgggttgcgacaaaatgggactatccatatatcgactgtttatgttcatattttcctttttcagtcctgatatccaccttaattattataatatcactatatttaatagacaaatcttcgccctttgtcgatttccttttcttctgtttaaagaaccacttaactttggaatataaaatcaattaacagcaaaacagcgtttgtttttcataattttttagtgaatgcataagcggctctcttcgggatgaagagagccgcttaaggtatatagagtacaatatagtacaagatcagaaaaaagtttaagagttctcagcctccttttttttcggagttattaacttcttcttgctgaaccaaatcagaatcatcaccccgatcagcaataaagccagtgacgcataagctatgctttccgtaacatgcaagctctgcgggtcaaaccacatctcaatcgtatgctggcctgcgggaacattcatcacacgcaagatatagtcagcacgggcaatgtccaccggctgtccgtcaatcttggcctgccagcccggataataaatctcagagaaaacagccactccatctttagcagaagaagtttcatataccaggcgattcggttcatagctggtcagacgaatggtagataaggagtctttgtaacctttcgtcacacccttcaactgatctttaaatttcgcatcaaccactgctgtttccgttggaagaatatcattcagcgcatcaatctcttcatttgcattattgacatactgcaccttatccacaaaccaagcgttaccatacgcataagggttttcaacaggaaccgtctgtccttgctgtccggcagggaaaataaagtacttcgtattcagcatattcagcacacggaatttggaagcgtccacactatccatcgcaccgcctgcgccggcaacttcctgataggcatccttcatttccggagttatatgatgatcgatcatttcctgataacgacgcaacttggccgcatgataaccacccacactcttatgccaatatgaggtattattttcattgaaagtattaccgggaaatcctacgaaattcaacaccctataattcaaagccgtatcctgaagaattatctcatccgtctgagttttaacgaatgctcctgtctggtttgacttcgatacaaattgttcatcattcaaatagcgcttattgacagtccacatatcaatcagacacagaagcacgatacctgtcatagtaaaagaagccttcaactttttctgctgataaaggaataataagaagcatcctactactataataaagaaactgcgccatgcatccgaagtcagcattgccttgcgcatttcggccagattcgtaatgatcggagataaatactcggcaggcagtccttgctgcagagctgccatctcttgtgccggaatataactagagaagaaaactcccggggcaacagccagaatcagtgaaacaccggctgttaataccaaagtgataattactcctgtccgattttctttcaactttaatatttccggtttagccagcacttcttttaaggcaaagaccgctaataaaggtatcgtaaattcagctataactaggatagaagatacggcacggaacttgttatacatcggtacataatcgataaaaaagtccgtaagtcccataaaattctttccccacgaaagtagaatagagaagatagtagctcccagtaaagcccatttcagcggtcctttaacaataaagcaccccaatataaacagaaataaaacaaaagctcccacatagaccggtccggaagtcatgggctgatcgccaaaatactgtgtcagctgcgaatagatgttactatacatcggattcgcctttgccatggcagtctcattcttggataaaggaaccgatgcccctccctttacattcggaaccagcaaagtaagcgtttcaccaattccataactccagttcgttatatagttacggtccagtccgctgctggtctgattggcagcaggtccttcctgtttcagttcactctttccgcgcatagtctccttactatactcataagtatggtatagattggagaggttcgcacacactcctatcatcgcagccaatgccagaacggcacttgccttgaaaaaatgcggcaactccttcttcttataagcatcttcaaagtaagctcctacaaaaaacaggatgacaaacatgaagtagtagctcatctgaatatggttcgactgaatctgaagcgcgataaacaaagcagtcacaatccctcccaacagatatttcttccgataagccagtacaataccggcaatcgtaggcggaatataagccaatgtgacaaatttccagatatgccctgccgatatcaaaataaagaaataggaggagaaagcccagataatcccccctaaagcagataaccagacagacaacccgaatgcccgcaaaaggatataaaacccgagcatcatgatgaaggtcagcaccacataagatggaagatacaagtgatagatgttttctatccacttcagcggtttggtagaatcataactcggagacatctgataggtaggcataccaccaaaaagagagtttgtccagcgggtacgttctcctgtacgttcaagatattcctgagcttcttgaccggctcccactccagccaccgtatcgtgctgaaacagaatacgactttcgatatcagccggaaaaaaataagcaaaagaaaggatgataaaagctaaaatagcaattaagtcgggaaggaacttcttcataaaattgacaattgacaattgacaattgacaattgatggtcaacaataacagcccggcagatcactcgttccatatagctgttcattgtcatttgtcaactgtcaattgtcaattaaattagtatctataatgttcagccttataaggtccgtctaccgatacaccgatataagcggcctgttccggagtcagcttcgtcagtttcaccccgatcttttcgagatgcaggcgagccacttcttcatccaggtgcttcggcaagcggtatacatttacttcgtatttcttgttgaacaactcgatctgggccagcgtctgattggtaaatgagttactcatcacgaatgacggatggcctgtcgcacatcccaaattcaccagacgaccgtcagccagcaaaagaatgctgtgaccatccgggaaataatagcggtctacctgcggcttgatgtttacacatttgatgcccgaataatgtttcaacgcatccacctggatttcattatcaaagtggccgatgttacatacgatcgcctgatctttcattttctccatgtggtcaatgcgaatgatatcgatattccccgtagtagtcacgaagatattaccttcggtgcaggcatcttccatcgttacgacttcgaaaccttccatagcagcctgcaacgcacaaatcggatcgacttccgtcacaagcacacgcgcaccataagagcgcattgaatgcgaacatcccttgcccacatcaccgtaaccacataccaccactaccttaccggcaatcatcacatcggtcgctctcttgataccgtcagccagtgactcacgacatccgtagagattatcaaacttagacttggtaaccgaatcgttcacattaaatgccgggaacagcaatttgccttcttcctgcatctgatacaaacggtgtacaccggtcgttgtctcttccgatacgccgcgcatttcctcagccacacgatgccagcgagtcttatcctcagccaatacttttttcagaatggcattcagttcgatttcatcctccgcatgcacttccttgtccaatacggcagcatcattctcggcatcataaccgacatgaatcatcatggtagcgtcaccaccatcgtctacaatcacattcggaccttttccgccggggaagttcaatgcctgcaatgtgcaccaccagtagtcggcaagattctcgcctttccatgcaaataccgcaacaccggaagcagcaatcgcagcagcagcatgatcctgcgttgaatatatattacaagagcaccagcggacttcagctcccaatgcaaccagtgtttcaatcagtacggcggtctggatggtcatatgtaatgatcccatgatacgggcaccttttaacggtttggattctccatacttttcgcgtagagccatcaggccgggcatttctttttctgccaaatcgatttccttgcgtccgaaatcagcaagtgtaatatctgccactttataaggcagagtagagaataattctgtagacatattgtaaatcatttaaaatgtaattgatgcaaagatagaacattctgattagtagggcaaaagctatccttcttttttataaaaaaaacacttacaccgggctcccattggctaaccaatataatatgcatatataaaatgcggtgaacatcttactaatgtccaccgcattttatatatgacaatcaacgttacttcttttcagctttcgttatcggcgcgctcagcatttccttatacttcgcaggatcattcaatacctttattgcttcctgcaaatcatcatcatccttcagttgctcgataataccacctctctggaaataataacgcttgataatttcattagcaatcattctcttgatatccttagagaaataatccaggtcacggtcaagattatgattcaacttcttttccagtgccttgaactcttcggcagcatctgtcatatagccttcaaattcagcagcctctttcagtgttttcagaatcttctcactctgctggtcatatttgaaatcggccttcttcaccagttccttgaaatcattgtaatcagcatccgtcactacaaacttttcaggagcagctacagtaggatgcttcaagcagtattgagttgcatagtcaaaaatcagattatcacgtacgagatagaacaagatattcgggagtttttcctgcttgacagtaatatcaggcattacaccacctccgtcacgtacttcacgtccggcagcagtatagaatacgttagtcagactgtcgggaatcgttcccacacttccatcttcgttccggtgcttatagtcgatcgcctgcacacaacgtccgcttgggatataatatttggaagtagtcactttcatcattcctccataaggtaaagaacggggaacctgtacaagtccctttccaaatgtacggttaccaacaataacggcacgatcaaggtcttgcaatgagcccgacaggatttctgaagcagaagccgtaccactgtttaccaatacggcaatcggaatatccagatccagcggttcacgcaaagtcttgtatgtgttgcttgcctgtttcgtctttcccttggtggttacgattacttttccacggggcaggaaataattggctatttccactgcttcatccaacagaccgccaccgttattacggaggtcgatgaccagagaagtagctccctgtttcttcagatccagcaatgcttttttgaaatccttggaagggttgccggagaatgtgctcaggctgatatatcccactttattatccatcacggtagcatatgggatggcaggggtctgaatagattcacgtacgatagtaaactccatcggggtttgtccgcctttctcattaggacgctccactttcagtttaaagctcgtacccgcctgtccgcgcaacatctggctgacttccgaattattctttccaaggagatcttttccgtctatttccatcaggatatctcccgccttcagtcccgctttggccgccggagttccctcgaacggttcggcaatcatggaacgtttcagcttcgtattataggtaataagagaaccgatacctccaaagcttcctttcaccatctgttccagttcgctttgatcttcctccgggtaatattctgtataaggatccagcgagaaaagcatattgtcgattccttcgcgaatggtcttgttcggatcaatggtatccacgtagaacatatccagttctttcacaatcgcattaaatgtatccagattcttggcaatctggaaattgcggtcgtctccactcttaaaactaaagaaagctacagtagctattacagccaccaaaacaagagctatccgcctattcagcaattttttcatatatctttcattaaaatgagacgtaaaagtaactcaaaccttggttattccgccagaaccttgttaatatttaacttaatttcatcccagcgctccggagagattgttgttccaatcacctgaataacatttcccgagagaatagaaccaatttttgcacatttttcgagcgagtatccgcacgtcagaccatacagaaatccggcagcgaaataatcgcctgcgccggtggtatccagaactttttctacaggaatagccgacactttaatttcttccgtacctttacggatataagatccgtttgctccaactttcacaatagcaatgctgcatttcttggctatcactctcagagcttcctccggttcttcgccggtaaatgctttcgcttcttcctcgtttgcaaaaacgatatccacatacttatttattaataaggagaaaaattccagatcattctccacgatattataacttgccatgtcgagacagatttgcaggccagcctctttagccagttcgatggcatgaagaatcatttcgtgatcctgaacaaggtatccttctataaataagtatgcatatcctttgaacatctccaatgtcagatcttcagctttcaaagaagcggccgctcccagataagtaccaaaagtacgctctccatcctgagaaataaaagtggatgccactcccgaaggaagctgttcggaggtcaataaattgtcttcaatattatttttctgcagatttttccgaaaaaaatcgccataatgatcatttcctacttttccgataaaacctgttccggcacccagacaagcgagtccaagtatggcatttcctgccgatccgcctgttgccagatgcgttttcatttgtgaaaattttgtgttaatctgctgtaacttagcgtcatcgatgagttgcatgcttcccttgggtaattccagttcatccaagagtgtatcgtctttcagggttgcaagtacgtctatcagggcgttgcccaatcctattattttgtccattctcaatattttttttgcaaagatattgcatatttcaaaaaaacctactacttttgcatcgcaattgagaaaaacattcttccttagctcagtcggttagagcatctgactgttaatcagagggtccttggttcaagtccaagaggaagagcaaaactgaaattcttgattgcaacattcttccttagctcagtcggttagagcatctgactgttaatcagagggtccttggttcaagtccaagaggaagagcaaaaagaggtgtatcgaaagatagacctcttttttgtttctgctcttctcccccctgcttcgaaaatagagggtcagtccgaaaaccgaaactctcatccccttcttttattcacaaaaacattcttgtcttttgatggtctataaaactttaaagattcaaaggttaacaataaactttccatctgaataaagtaagttctttgggtacatgaattaattcgtccggctataggcattctttcgtccgcctatagccggacgaaagtttgcctataggcaacgttgcgtttgcccataggcggacgaattaatttatgaagagaaagtacttatttgtagaacagcaacaacataatgtaagcattggcattcattatagtttatatattaaagagagtcttcgggaagacgacaagctaccctattctgccatagccaacgtcaacacactaatccgtactccttcaatctctgccagccgagaagcgcacgctacggtagttgctccagtcgtcaacacatcatctactattaatatatgctttcctgccaaatactccgaacgatgcaattcgaagattccatctacattctcccaacgttctaaagctgacttttgtgtttgcgtttccgtattcttccggcgtatgattgcttcggtatccaccggaatacctgttacggccataatcccgcgcgatatccattcactttgattgtagccacgtatctgctgtttcttcttatgcaaagggatgggaatgattacatcaactccatgaaagaagtcggaagcctgcaattcggatgccatatatcgtcccataatagcaccaatttctttttgtcctccatatttgagttggtggagaacttgccgaaaatcacttcctttgcgataaaagaaaaaagaagtggcacgttccagaggaaacttaccccaaaagagtttttctaccggattgtctttccgaagatgataatcggtacgaggcaagtttatattgcacatggtgcaaatacactcttctcctttagccaacgatccgccacaaacgacgcagcaacggggaaaccaaagggacaaaaaagaataaagccaatcttttataagtaatgtgtgtttcatagtagtagctatttatacaatcgcagcagtcttacatatccaacggaggaacttctgctaagagtttcaaaaataaaggatgcaggtatccattggttgcaataatatgatgaccttctataaaatggtcgtcaccatagaaattagtcacgcgaccgcctgcttccaacacaatcagggcagccgccgaataatcccacttaccgataaacgcttcggcccatgcatcaaaacgaccattagctatataacagattgcagccgcagccgaaccgttcatgcgaatgcctcccacggctccataaaggttatcaatcagatggagagccgtcggtttatactgatcataattataaggtaattcagtaaacacaaatgcattcttgatatcccggacatccgaaacatgaatttcctcaccattcatgaaagcctttcctcctttccaggcatagaaacattcattccggcagacttcatacacaactcccaaaagcaattcggtacgactgcgcagagcgatgcatacacaataaggagcctcatcatgaatataattcgtagttccgtccaacggatcaatgacccagcagtaaggttcgtcctgataagtagcagagccttcttccgtaataaatcctgcttcgggcaacaaggcagaaagcgcttttaccaaccgtacttcagactctttatccacatacgacacataatcatgcgcatgtttttccataacacgctcacgacggaagtttttccgctcttctttcagaaaatgcccagcttcggtagctatgcggcatacttcaactgtaagttgctttaaatccaacatttcatctttattattaaaaagtacatcgaaggtatagcttttcttatgaaaaaccatccaaaatgagtattattttcagatagactatcaaacattcaattttcaaggcagaaaaacattcaatcacattataatatatttttctgatctgaggaaatgagaattccctgcaattttcagaacaggcccggcctcttcccacaaatatacgcaacaaagagctacagaaaacacaaagtgacagaatgccagatttgctttttacataaaaattcccgaatattgcaatctaatactaatgcaaagagttccctatgaaaagagtagattccgttatatccctgatatactcgttatctaaatcagaaaagaagcacttctccctacaggttatcaaggacaaggaggaaaaagactatctggtgatttatgatattatcataaagagtaaacaaccgaatggaaatactgtaaaagaggaattttacagacgcaagcccaatggctcatttgaagtatccattcaatacttatatgaaaagctgacggatacgttactcaccctgcgtaaaaagaaagatatctattacgatctgctgaataatttgtgcaaagcccgaatgctttatgaacgttctctgtttgaagagtgtttcgaaatactatccaatacaatagaacaagcacaattctatgagaacaacgaaattctgacgatagctttgaagctggaactggaatatctgctccgtctgaactttcccaacatgacagaacaggagctttttcacaaacacttcatccaaaatgaagctttgaaaaagattcggaaaatcacagagcaatcttcattacacaacttattgaaatatcgtttatctcatattggctccatcagaacagtaaagcaaaaacaggatatgaatgaccttatggtcaacgaactttatatagccgcttcttcagactccgaaggtaattttgaattaacacgaaaccataaactttttcaggctaattacctgatgggagcaggcgattacagagctgccttaaattcatacaaagaactagactcattatttgagcagaatcagcagttctggtcaaatcctcctatatactatttatctgtactcgaaggagtactcggtagcctgcggtctgtgagcaactatgacgaaatcccctacttccttgataaattaagaaagcttatatcagacagcacttcgctcgaatttaaagtaaatgcaacttgccttctcttccaatacgaactatttccctatctggataaaggagatttttcgaaatgtacccaacttatggcagactaccaggaaatactttatgataaagaagcctggttaggccctattcgaaaaagtgaattattgctttacaccacactcgtacacattggtaaccaagaatataaaactgctaaaaagtatatcagcaacgctatcatagaccataacataaagtatctgcctttaatgagaactattcgtctggtccgcctcatcgtcttttatgaagtgcaggagcatgagctaatccagtatgaatcccgttccatcacccgaagtctatcttcgcccaaagagcagacttttaaaacagaacgtatcattttatggtttctgaataaaagaaatattcccatcctgaaaaaagacagagaagcattttgggaaaagttgtctcctgagattcatgaattatataataataaatatgaaagtcagcttttacgcctctttgactttacggcgtggatggaatccaaaattcggaaagaaaaactgtctgaagtcctcagagcacgtgctagcgcaaaagaatgttaaagagtaaggtgtctgattcgtatttcagacgataaaaacactcttttcaaatctccattttctctttgtaattatataaattcgcttcacattacctctatattctctcctctatacaaggaaaatccaatataagatatcatttttgagattatataaaccaattattaatgtagaaaactatgcatgattattgctttcatttgcatagtcttaatttttaatactatggaaactatatcaattcatagacccaaaattgtagtcatcggtagttgcaataccgatatggtcgtgaaagccaacagactacctgttcccggagaaaccatactaggcggaaccttctacatgaatcccggtggcaaaggagctaatcaggcgattgcagccgcccgactgggagctgaagtcaccttcatatccaaaatcggatatgatttgttcggcctgcaagcattggaaatatacagatcagagaaaattaatacggaatatatatttaccgaccagaaaagtccgtccggagttgcacttatctccgtagattctttcggtgaaaatagcattatcgtagcaccgggagcaagccgttcgctttctattgaggatatcaataaagccgaagaaaaaatcaaggaagctgatattattctcatgcaacttgagattcccatagacacagtggaatatgcagctactattgcttgcaaatatgggaaaaaggtaatcctcaatccggctcccgcgtccagcctgagcaactcattcttaatgaacgtgcacaccatactccccaaccgcattgaagcggaaatgttatccggaatcaaagtgatgaatatagaaagcgctcatcgtgccgctcaggctatcggagagaaaggtatagagaatgttgtcattactttaggtaaagacggggcttacgtaaaagagaaagatgaatataccatgattcccgcaaaggaagtagagacgattgacacaacaggtgccggagatgtattttgcggagcattcagcgtctgcctgtctgaagggcattcactcgctaaatctgtgaaatttgccaatgcggcggcagctatagcagtcacgcgaatcggtgcacagagtgcgattccttataaaagagaagttgtgctataaacgagataagacctaggttaaacacataaatctgttcaaatgaaagtagtagttattggaagttcaaacatcgacatggttgcacaagtcaaccatctcccggcgcctggcgaaacagtcggagatgccagtttcatgcaatccctcggggggaaaggcgccaatcaggctgtagcagcagcaagactcgggggatctgtaacgttcattacctctttgggaaatgatatgtatgcagaaattctaaaaaaacactttaagaaagaaggtatcactactgattatatcatagatgatgttaatcagcccacagggactgcactcatttttgttgccgacagtggtgaaaactgcatagcagtagctcccggagctaactattctttattacccggttcaattattcatttttcaaaggtaattgacgaagcagatatcatagttatgcaagccgagattccttacgaaacgattaaaagaatagctcttctggctaaacaaaaaggtaaaaaggtattgtttaatcccgcacccgcctgcctgattgatgaggagctgatgaaagccattgatatactagtcgtcaatgaactggaagcagccttcatctcaggaattgaatatacaggaaataatcttgaagaaatcgctctaagcttattacaggcaggtgcacgcaatgctgtgatcacattaggaagtcaaggtgtatatatgaaaaacgacaaagaaatcattcagcttcccggatacaaagtaaatgcgattgatactattgcagcaggtgacacgttctgtggtgcattggctgtaatttgtgcccaaagggaaatagaccgagatgcattgagttttgcgaatgccgcggcagctatcgctgttacacgttctggtgcccaaccgtctattcctactctcgatgaagtaaaacacttcatgttagaaaaagaattagccttatcattcaacttttaaatttcatggattatgaaaactaatcgacactctactctcttaaagaaagctgtccacctgataacttataactcaagtcataagcttatctgcctgctgggctacctacttttatgttcaatgaatacatatgctcagaattatgtatccggaacagtaaaagataataatggagaacctctactgggagtttccataaaagtaaaagatgggaatatagtatccggaaccgtcactgactttaacggacactaccaagtgaaagcggatccaagttcaactattgaattcagttacatcggatttaaaacagtccagtttacagtaggtgatagaaaaatgataaacgtaacactgggagttgacgacaatttattggatgaagtgatcgttgtaggttatggtacccaaaagaagattaatttaaccggttctgtcggagtcattgactcgaaagccttcgaagcaatccctgtatccaatgcagtccaggcattacaaggacaggttcccggtttgaatatttatagcaatcagggaggaggtctcaatcagaaacaatcgatcaatgtacgtggagtcggaactatcggagaaggttctacaggaagtgccctagtcttgatagatggtatggaaggagatatttattccattaatccgcaggatatagaatctatttcagttctgaaagatgcggcagcttcttctatttatggttccagagcgccattcggagtaatcttagtaacgaccaagaaaggaaaggccggtaaagcgcaagttaactacaacaacagttttcgtgtaagtagccctatcaacatgccttcttcattagactcttacacgttctccttatactataatgatgcagctgccaattccggatggggaccttacaactgggtctcggaagaaaggataaaccgcatcaaagactatatggccggcaagattaccgattctaccatccccgtgcccaataatccttcgttatgggcagacggatattcacaaggaaatgataatattgattattatgactattttttcaaagacaatgtctttgcacacgagcacaatatcagcgttactggcgggacagacaaaatacaatactatttatcagcgaactatttaggtcaggatggagagctcagaatcggagatgaatactcaaacagatatactgcatctgcaaaaatcaacgcacaattatcaaaaatagtatcagtcggattcaatactcgctttatcagaagtgactatgtacagccgacacatcttaatgaaagtttttttgccgaaatcggacgccaatgttggcctaccaaacctctctatgacccaaatggtattctatatgacgaccatgtgctccaaatgcaaaacggaggtgaaaaacaagaacgaaacacttggctctaccaacaactgaatataacggtagaacctatcaaagggtggcgactgattggagatttaagctatcgatacaatacacaatattcacactgggattacttaactgttcatcagacaggtgttgacggaaagactaagggcaatacatggaataacgattcccaagtacatgaaggcacttatgccagcgattattttaatgtaaatctctatacagattatgcaaagacctttgcaaaatcacataatatgaaagttcttttcgggtttcaagccgaacaaaataattataaagatatagctgctgagaagctaggagtcatttatccgggaaaaccgactatcaacacttctaccggaatggattcaaataaccaaaaagttgctccgaatgtagcaggtggacacaacagatgggctaccgccggattcttcggcagattgaattatgattacctggaaaaatatcttctggaagtaaatctacgctatgacggttcctcacgatttcgtagtgacagtcgttggggatttttcccttccgcatcagtaggctggaacatagccagagaaaaattcttcctgcctgtcagcaaagttgtcaacacatttaaggtcagagcctcttatggtagtttgggtaaccaaaatacatcttctttatatccgacttattctacaatcggtacaggaacaggatcatggatcattgacggaacattagccaatattgcctgggcaccttcactcgtcagctataatctctcctgggagaaaatccgtacatggaatgccggagttgactttggcctgtttaacaatcggctaaccggctcttttgattattacattcgtaaaactgacgatatggtcggcccttcggagaaattgcctgtagtccttggaacagccgttcccagttccaataatacaaatcttaaaacattcggatgggaactggaactaatgtggaaagaccggttaaataatggattgaattatagtgcccgctttacacttgccgacagtcgtaccaagattactcgttattcaaatccttccggactgatagatggattttatgccggaaaatacgtgggtgaaatatggggatatgaaacgataggcattgcacaatctgaccaggaaatggccgaacacatcggaagattaatcaacggtggacaaagtaatctcggacaagactggaaagccggagacattatgtataaagatctgaatgaagacggaaaaattgatgccggaagccgcaccttacaagatcacggtgatttaaaaagaataggtaactccacgccccgatataatgtaggactggaattagccgccgattggaaaggattcgatatcagaatgttctggcaaggaacattgaaaagagattattttcagggtagttactacttctggggtgcaaacggtagacaagggccctggttttccacagcactaaaaggacacgatgattatttccgaaatgacgaagccagtccattgggaacgaatctgaattcctactatccaagacccttattcaacaccgataaaaaccagcaatcacaaactaaatatttacaagatgcatcttatctacgtctgaagaatctgcagataggatatagcttgccacacaacatcgtacaaaaaatgggaatgcagcaccttaggatattcgcatccggtgaaaacttgttcaccattacgagccttattgacttcttcgaccccgaatcaatcgaaggcggtagttggggacacggaaacgtttacccactatcccgaacattctcttttggattaaatgtcacattctaaaaacaggatattatgaaaagacttacgatatcaaccttattgagcggagtgctctttttgacaagttgcaatgatttcctaaatcaagaacctcttgatcaactttctccaaatgaatatctgacaacagaaagtaatattgcagcttttgctactgatcaatatcaagtgctacctactcatggcacctatggatatggaacttttgaaattgacaataacacagataatatggccggtatgcaacctaacgtaatgtatgcacccggatactggaaagtaggacaagaaggaggctcatggtatttcgctgatatttaccgatgcaattatttctttgaaaatgtgcttccatcgtatgaaaacaatgccattgtcggaaacacgaccaatatcaaacactatatcggagaaatgtatttcttcagagctttcatgtattttgaaagattaaaatcattaggcgactttcctattattactaaaacttatcctaatgaacgtgaagctctgatagaaatcagcaaacgagccccccgaaatgaagtagccagatttatcttatctgatctggacaaagctatagaaatgatgcaaaacatagctccttccggaggtaagaaccggctaagcaaagactgcgctatccttctcaagtcaagggtcgcactttacgaaggctcatggctgaagaattttaaaggaacagcttttgtacccaatggaccgggatggccgggagcaaataaagattataatgctaattactcatttaaatccggaagtattgaaaaagaatcagagttcttctttgatgaagctattaaagcggcacaaatcatagcagaaaaatataatatattaactgccaatacaggagtattcccacaaacttcttcggaacctgaaaatccttatttcagtatgttctgcgatattgacatggagaaatacaatgaagtacttttatggaggcgctacaacacaggattaggagtggcaaatgaagtttgtcaatacggatgtgtcggcaacaatggagtaggcactactaaaagcatgattgacgcctttattcttaaaaatggagaacctatttatgcatccccgatgtgggcagatgaaaactcatcttattggggagataataatatcattcatatcactaaaaacagggatacccgtgcagacatcttcatcaaaaagccaggacagaaaaatttgcatactcaggcaggagatcatggggtagtagaagaatggggacccaatataaccgcctcttctgttacagaaaagtacaatacaggctatgccttacgcaaaggattaaaccctgacgggaaatacacaaataacactcaaagtattgtcggttctatcatattccgtacagccgaagcctatctcaactatatagaagcttattatgaattgcatggttcactcgactcctatgcagaaaagtactggaaagcgattcgtcgcagagccggcattgatgaggactataccaaaacaatcaggcttacagatatgtcaaaagaagcagaaactgattggggggcatattccggcggagaaattattgatgccacacgttataatatccgccgtgaacgaagatgtgagttgatggcggaaggtttacgtagcatggacttacatagatggcgttcaatggaccagatgattaccaaaccctaccatatcctaggaatgaatttatggcaggaaatgtatggctgggactggtataaagattctaacggcaactccattcttaaagaaggagaaaatgtttcaccacgtagcttcagtacttatcttgctccttatcacatcacagccaataacattgtttacaacggctataaatggaatatggcacactatctcgatccgatagcagcagaacattttctggttacttcatccggaggtgatttggattcttctcctatctatcagaatccgggctggcctatgacaggaggaggaaccccgcaataatccaataatctactaatttaacaaagaccaattatgtataaaagaatgataatactaacttacgcactggttttcttttcattattcgcaacagcttgttctgacaataataatgaaacatacgtcgaaccaatactttctcaaatagaagtaagtaaactagtgactgaaaacaacaaaacatatgtttctgttgacggtaaaccttttccgtttcttggtgcacaaatacgccttgatgcccttctcaattgtgacaagatgactattaatgaagtggaaaactacttcaagaaagctcaggaactgggactaaattgtgtacaaattccaatttcatggaatatggtagagcctaaagaaaacaagtacgattatagtatcgtaaactcaatcttgcagttcgtcaacaagtataatttgaaaatggaattactttggttcagtacgaatatggtaggagattcattctcctacctgatacctcaatatgtgcttcaagaatataacaaaaggctcagccggaatgatgaaggaaatttttggaactattatggttatcaatacaccatgattcttgatgatgaatggatactggagagagaaaccaaagccatcaccgccttatttaaccacatccgatactgggattctcaaaatggagacaagcaccccgttatatcagctcagatccataatgaacctgatgcgttaatgcgctggagaatcgaccaaaaagatttaaaatatcgggatgggacccctctaagcaaagagaaggcctggacaatgatcacaaatgcattaaatactgtaggaaaagctgtaaaaaacagttcttacagagtagtaactcgtgtcaatctaatttacggtgatggtattaatccatttccagaggctactaatgctcgccccaaagatgtattcgatcttcaaggcattgatttcattggcgttgatgcttataaagataatgttaaacatctcaaaaatgaagtcatggcatacgcatcaattgcaggaaattatgcgctggttgccgagaacaaaggtagttatgcaaacagtccgagtcttatcttgacatctttcgcattaggaggaggctatgatatttacgatttggctaccagtaacttctttatcaacaacaccaccgaaccggaccaaattgaccacggaatttatacatgggatttacaagaaaaagattttacacctcctactcgtagtctcataaaaggcttggcggcagcttatatagatgttgccaaagtaaaaccggagaactttgcagcatttaatattaacgataatcagccaaaagacaaattagaacaactaatatgtactactggagcacaaatcacattccagacaaataatgcttctttaggtttcgtattagatatgcacaattatttactgatttatagtttgaatgactctcaattcaaactagagaatggtaaatttggagaaaccatttccggaagatatgatgtaaatggcacatttaccaaagaaggaactgcaactttagaaaatcagactctccatgctaaaggaggcgtactttataaagtaaattattcctcgcaacaatcattaaccagcaatacaattgagaatattggaaataacttataaaaacccaagatatgttcaaatatatagcaatcattctaataaccgtctctttattctgttcctgtgcacaacagaaagagactacttctgcaattcctgtcatactcgacacggatgttggaaatgatatcgatgatgttttagccatgcaaatgctgcttaattatgagaaaaaaggaaaaattgatttgctaggtatcactataagcaagtgtaatccttattcactggaatatattgacgcttattgtcgtttcaacgacaaatacgacatacctttaggttatgcttataatgggatgaatacagacgacggacattatctccgccaaacgctggatactattattgacaacaataaaatattacatccaaaaagaagcctaaaagatcatattctggaaggatataaactgttgcgtaaattgctggcagagcaagaagatcattctgtggtatttatagccttaggcccggaaacaaatctagcccgtttgcttatctcggaagcagatgaatacagcgagctggatggaaaagccttggtagcacaaaaggtaaaattactatctgtcatgggaggactctatggtaatgaattcgacttccctgaatggaacattgttaatgatctgaatgcagcccaaattactttcaaagaatggcctactccaattattgccagcggatgggaactaggaaacaaaattcgatatcctcatcaaagtatattaaatgattttgccggcagttataaacatcctctgtgcgtatcatataaaatatatcaggaaatgccatatgacagagaaacatgggatttgacatccgtgctacaagccatagaaccggggaataattatttcaatttatccgagaagggaacaatcaccatagacagtatcggacaaagtattttttctccttctgaaagcggtaaacaccaatatctcactattcaaggggaagaaaatattcgggcaacccgcaacgcacttataagacaagtgacaggaaaagagaattgaaatcttaaaaaaaatcattatgtatatagtcaatagttacaccttagctattatcttctgctttatcacaatgatatgctggggatcgtggggaaatacccaaaaactggccagtaagaattggcgttatgaactttattattgggactacaccatcggcatcttgctgttcgccctacttctggtattcacactaggaagtttcggagattcgggaagaggttttctggaagacatccaacaagtggaagcggcatatattgccagtgcacttatcggaggagctattttcaatgcttccaatattctcctttccgcctcagtatccattgccggaatggcagtagcttttccattgggagtaggactggcattggtattgggagtattcattaattatttcagctcccccaaaggagatccgttctggctattcacaggagtcgtgctgattgttatcgccatcatttgcaacggtattgcagccggtaagaatcaaaaggcgggaaccaataacagcaaaaagggaattattcttgctgctattgccggtatactgatgtcattcttttaccggtttgtcgccgctgccatggatttgaacaactttgaatcaccgacaaccggaatggcaactccttatactgcattcttcatctttgctatcggaatcttcctaagcaacttcctcttcaatacacttgtgatgaagcgtccgttcgttggtctacccgtcacttacaaggaatactttgccggaaaagcaagtacacacatggtcggaattctcggaggatgcatctggggattaggtacggcattaagctacattgccgcaggaaaagcgggagcagccatttcttatgcacttggacaaggagcaccgatgattgctgccctttggggtgttttcatctggaaagaatttaccggtagctccaaagcgacaaacagacttttgggagtcatgtttatattattcattttgggcctgacattcattgtcatctcaggaggaagctaaaataaaaaagaggtaaaggaactattaggtattatcaatataaaaagaatcaccccaaaagttagaaactaaacttttggggtgaaattcaattctatgattcaaactatcatatacattattcagaccgttatatccagcaaagtttctccctttgcatccaacaccctgactctgagttcttctttcctcttctcaagaatcatcacggtagcaccctccatcttatatcctccacctataacaaccggaaaatgattccccaattcacctttcgggtgataagcatacttatgagtatgagcattcagacagatatcaaaaggagctttttccagcagcttagtccatagttcagtacaaagattctttccatcattaccataaagagggatatgatgcaggaggatacgttttttcgctttcttaaattctttggcagccagttctttcttcagaaaaccgacctgttcgttacgtaactgggtgaaatcattcaaatcataatagacccaatgatcgtctgttttgtcttctccacagtccagcatgacaatacgggtatctccccagttgaaagagccataagtcttgtcacctacataatcgaaatggtcacgcaaaccgatagaataagcgttccggatttcgtgattcccccgcataaagaaagtcgggatacaatcaccgcgcactccttcggtcagttcactgataaaggcagttgcctgatcatgacttgccgggtcgtctacacagtcaccgttgaaaacaacaaaatcatagtcaatatcctgaatttgcctgcacaaagcccggaaggtatgggtatgctgatgcagatcattgaacacaacagcagtaaaagaatccgtaccggttacaggcagagtaaattcactgaaagcagaacgggcagtatttccgaaaactttcttatatgcctgataaagcaacatttcttgtgaacagacacgataataatacttttgaccgggctgcaaatcatccagccgtattttatgtaacttgttattgcagactacctgtccgtcaacaatagtacgcgcacgctttaattgagtcgtatccgtaccgtattctacccaacaataagcaggaacagtggtttcccacatcacggtcattccatttccaaccggattctgcaaatagggtttagtacggaatatcttatccgccttttcggcagtgcgcagttccacaacaatagggcgatgatcggatgctacaggttcattcaccacttccgaagagacgacggcaaatcctttatcattctgcttaaaagccgccacgtaatcgatagtctcctttggggcgggagcaggaaaagtgtgttgtctgggattagagagtatccgaaattctttctgcaactctttaataaagtccgattccggctccgcattcatgtctcccgccagaaaaagaggctttttataggaagctgcaaaagttttcagaatctccaatgacttcatccggtcttcttccgtaagggataaatgagtgcaacagtaaatataatcttcaaactccgctaagatcaatgcacgggcttcttccctgccgggcagagctatagtctgcaaatgaaccggagctttctttgacagcagaccgattccgtattttccgccatcataatctatagccggagcaaagcaggcatacatctgcgtccgctcggctatctcacctaatacatatttctgattactccgattggtcacgctatctacttcctgcacggctaccacatcaggagaagcgttattaatcacatttgcaatacgctggaagtcacagacaccatccatgcctgttgcatttttgatgttataggtcatcagtctcaacgtatgctgagcctgcaccggaacaattaacaagatcgcggaaatcagtaagaatatctttttcatgtttctcattgggggttaaatattagaatcacaaaggtaagaaaaaaataaaagccacaagagactttttacaatctctgtggccattacttatacaatcagcccccgcacgcggtcatcaaaggcagaaagggcggctttggcaccttcgcccatagaaataataatctgtttgtaaggtacggtcgatacgtctccggctgcatagattcccgtcacattggtacggcaatgcgcatcgataacgatttcacccggtcggtttgtttccacaatatcacggaaaacgctgctattggcggaaagtccgatctgcacgaatactccgtccagttctaccaaacgttcttcttccgtcttacggtctttgatgcgcaaggctgtcagtttatcgccattaccaattacttctgtcgtttgcgaactcacgaatacttccacattcggcagagatttaagtctttcctgaaggacattatccgctttcagttcatccataaattcaaagacggtgactttagaacagatacctgccaagtcaatggctgcctcgatgccggagtttccaccgcccactaccgcaacctgctttcctttatagaaaggaccgtcgcaatgaggacagaaagcgactccacgcccgatataatcgttctcgccgggaacattcagttttcgccagcttgcacctgtagcgataatcaatgcaggagcaatgaatttctctcctacggaagtagttaccagtttatcttttccggcaagttctaccttttctatcttacgctgttccaacaaatcaacaggataacgcagaagatgcgttttcagattatcggcaagttcgcttcctgttgtttcgggaaccgaaatcagattctcaatgcctaccgtctctttcacctgtccgccgacacgctcggcaacaatcgccacgcgcaagcctttacgggcagaatagatggctgctgatactccggcaggaccgccaccggctacgataacatcgtattccttcacttccgtctccaccttggtttcatcaataccgtattgcgcttccagtttagcaagcaattcgccaaattcgccacgacctacatgaagcagtttcccatcggcaaatacagaaggcacgccttgtatcttcaaggcatccacttcatcctgatacagtgcaccgtcaaccatttcatgagtaatggaaggattcagtgtggtcattgcattcaatgcctgaactacatccggacagttggtgcaagtcagtgagacataggtcactaagtgtatcggacccttcaaggctttcacacggttgcagacagcctcatccggaaaattctttcccttaccgtccagattcaggatggcgagtaataaagaagtaaactcatgtccgttggggatagcacggaaagtaatttctgtaggtttaccattctttcctatcgtaaatttaagtccgcttccttcatttaccatacaagtgatgtgatcggaacattcggctacatcgctcagcaattccagcaattcggcacggctttcatgactggctgatacggatatatcaaaggtaaagtcagcctccagtccggcaaaaatacccttcagttgttcttttaatgcaggttctaacatctctctttctcctttcattcttttaaaagaagggccggcagcgtctccgttaccggcccttcacacacattatcaagatctatcaaatcttaccgacaaggtcaatgcttggcttcagagtagattcgcccttcttccatttagccgggcaaacttctccgtcgtgagtagccacaaactgtgcggcttctactttgcgaagtaattcgctggcgtcacgaccaatattgttatcattcagttccaccactttaatctttccttccgggtttacgacgaatgttccgcggtaagccataccttcttcttcgatatatacacccagtgcacggctcaaagcgcctgtcgggtctgccagcatcgggtatttgatcttacggatactttcggaagcatcatgccaggctttgtgtacgaaatgcgagtcagtacttaccgagtagatttccacacccatttcctggaactgagcatatttgtcagccatgtctaccaattctgtcggacatacaaatgtaaagtcggcagggtagaagaaaaggattgcccatttacctttcaggtcgttgttggttactgtcttgaaagctccgttttgaaaagcctgaacactgaattcaggaagttgagaatttaaaattggttccatactctttattgcttttattgttattaattgatttgacttataacatcagaaacatcgttttgttttttgtttctgatgcaaagataaaggcggaaaccccgcctttgcaaaaaaagtccaatcgaataattctatcggataatagatgaaaccaatatgcctgccagtgaagctgccttcttctacttctttgttttcagtaaacgcatactgagaaagcctgccaaaaagataacaatggttccgaagacaatagtcaggttagcatgaaacgggcttgcatattcgctcataaaaccatctttaaagaagataggagacaagctcatccagacgacaacgataatgccacagatcactcccaaaacggcgtcaacattccgcgccttctttgaaatataccccagcaggaagagtcccagcataccaccgctgaagatggaggacaaagcccaccaggcatccagcgcactctctacgttcagaaatgccagcgctacgaaaataccgattattccgatcagtacattcgaaacatacaaggctctcaccgattgtttttctgtcggtctcttatttatataacgggcataatagtccgtcagaatgatagtagccgaacttgtaatgcttgtagccaccgtactcattcccgccgcgaaaatggaggcaatcaataatccggtaagtccggtcggaagcgcatgtacaataaaatagggaaagaccgcgtccccctcgacccctgccggaagcagttccggaaacgtcttgtaatatgcatacaatgccgtacctatcataaagaacactgcagaaaccggaataaacaaataacctccgaagagagcggagaacttagcctgtttatcactctttgccgtcaaataacgctgtacgtagttctgatcaataccataattctgtagattgataaatataccgtaaataaggcatacccagaaagtagactcggtcagactgctgccgaaacttcccaaactgaatttctggtcagtaatggctatctgaaatacctgcgcaggcccttcgggcattttaaacatcagcacacaaaggcaggctatcgcaccaccaatcagaataaatccctgaatcgcctccgtccatatcacagctttcagaccacccaacattgaataggcaataatggcaacgctggttactgcgataatcatcttgatatcccatcccagcagggcattcataggcaatgcgagcagatacagaatagaacccatccgggcaacctgcgtcaaaagataacacgatgacgcatacacacgcgcccagggtccaaagcgttcttcgagaaagctgtaagccgatacgcttccgatagaacgataaaagggtacaaagtatttagcagcaaaatacgaggctatcggaatggacaagctgaatacaaaagcattccaatcggacatataggccttgcccggataagccagataactgatactacttacatacgttgcgaaaatagacattcccacaacccaacccggaagggaacgtcctgccgaagtaaattcctccgacgaacgtttcttgttgaagaaagagcagccgaagacaacaactccccccgtgaagaataaaaagataataatgtcgagaatagacatagccgttcattttttcttgattaattacctgagcactacatcaactcccagattttgaagcgctttccatatttttcctctttcccgttgttcgaacttatggaaaggcgcagccacataatcgctgcatattccgagtagactgagagcacatttcagacctttcaggtaactggacccatgttgccctaccgtatatatcgtagcactgatttgcattactttttcctgcaaacgtctcacttcttccatatctgcattcttcgcggcgttgtataagctcacatacaattcggggaacatattcgcaccaccgtttacgccgccatgagcccccagcagtacggattccgccataatttcttccggtcccaccagcatcgagaaatccggattatctttcatggcatacatcaccgactggaaataaaccgtatttgccgaactgtctttaaaaccgattacgccgggattctccgctatccgctgaatcgtagccggtgcaaagcttacctttgtatgagtcggcatattatacaagaataatggtaacggcaactgaggcagcagatgctcataaaactcgatcagttcgggctgacctgtcgcaaagtagtaaggaggagcagaaacgacggcatcggctccatgatctgccgcaaggcaggcaaggttcacactctccacaatcgaagtatcggaaatacataccaataccggcaaccgtcctttcgctatacggcaggtattcttaatcatttctaccctcaatttatagctgaggctctgtgactcgccagtagttcccaacacaaaaagagcatgtactccccctgctatcagatgttcgatcaatctttgcaaaccttccacatccagcacatcatcgtccagcaagggagttaccaacggaggaataattcctgataaaggaatattcattttgttattcatagtctgattcttttaatttgtatatgattgttattaatgatactaataagacggggtatttagcattttgtaatcacattattccatatctgaagaaaagattttatatttttgtcggcaaacaatctattatataaaatcagttatgatgaaccatcctcttgcccaattcctgtactgccccgaatgcggttctccgcacttcgaagtaaacaacgagaagtctaagaaatgcacagactgcggctttgtttattatttcaatccgtcttccgcaaccgtggcactgattctgaatgaaaagaaggaactgctggtctgccgccgtgccaaagaaccggccaaagggacactcgaccttcccggaggatttatcgacatgaacgaaacgggagaagaaggggtaagcagggaagtatgggaggaaacaggattgaaggtagaaaaagcgacctatcagttctccctgccgaacatttatatctattccggctttcccgttcatacgctcgatatgttctttctctgtaccgtaaaagacatgagccatttctcggcaatggatgacgtggcagattctttctttttgccattatcggatatacatccggaagatttcgggctggattccattcggcggggacttgtacagtttctggctcaacacagttaactaaagggggcactaaacttttgggtatcagaaaacgttttaaatgaggaaaatactaagattcgtattatctttgtaaccgccattaattataaaccaacaatcacatgaaattcaacatcagacttaattactctcatcaggaagatgaaaaagagtcccaaaagaataagtatttcggattcaaaatggatgagagataatttacataaagatttaaatgattataaaataactttcaaagggttttcgttggaagatatagtcgtatttttgtcaaaacactagattatgaagaaaagaatatcacgaattatctgcaccttgttgtgttgtgcaccaattgccatctccgcacagacaagcgaaaagataacctctcctgtcaacctttataaagaagggaaagagcttttccaggaaaaaaattatgcagccgccatacctgcattgaaagcatttgtaaagcaaaagccaacagcaagtctccttcaggacgcagaatatatgttagtcagttcagcttatgaactgaaagacaaaaaccgcatcgagttactgcgcaagtacctcgaccgttatccggatactccctacgccaaccgaatctattcgctgctggcttcctgctacttctacgaagggaaatatgatgaggccctggcactcttcaattctacacggctcgatctgctgggaaatgaagagcgcgacgaccgcacctaccaactggcaacctgctacatgaagactgataatctgaaagaagccgccatctggttcgaaacgttacgtgccagcagccccaaatatgcaaaggactgtagttactatctcgcttatatccgctacactcagaagcgttatgatgaagcgttgaaagacttccttcctttgcaggacgacccgaagtacaaagaactcgtaccttactacatagcagaaatctatgctatcaaaaagaactatgataaggcgcagattgtagcacaaaactacctgtcggcctatccaaacaacgagcacgctgccgagatgtaccgcattctgggagacgcttactaccatttcggacaatatcaccaggcagtggaagcattcaccggctatctggacagagatcattccgctccccgccgggatgcactttatatgctgggactctcctattaccagacaaaagtctactccaaagcagccgaaatgctgggacaagtgacgaccgccaacgacgcactgacccagaatgcttacctgcacatgggactctcttacctgcaactggcagaaaagaacaaggcacgtatggctttcgaacaggcagccgcctccaacgccaacctgcagattaaggaacaggccgcttacaactacgcactttgcctgcacgaaacgtcctactccgctttcggtgaatcggttactgcttttgaaaaattcctcaatgaattcccgacttctccgtatgccgagaaagtaagcaactatctggtagaagtttatatgaatacccgcagctacgaagctgctttaaagtcaatcgaacggatcgccaagccgagtgcacagatcatggaagccaaacaaaagattctcttccaactgggtacacagtcatttgccaatgccaatttcgaacaggctctccaatatctgaaccagtccatcgccatcgggcagtacaaccgccagacaaaggcggacgcttattactggtgcggagaatcttactaccgcctcaaccggatgatggaagccgcccgcgatttcaacgcttatctgcaactgaccacgcagcccaataatgaaatgtatgcgctcgccaactacaacctaggatacattgctttccaccgcaaggactatacacaggcaagcaattacttccaaaagtatatccaactggaaaaaggcgaaaacagaacagcgcttgcagatgcctacaaccgtatcggagactgtcatctgaatgtacgcaactttgaagaagccaagcactactactcgcaagccgaacaaatgaatactccttccggcgattactccttctatcagctggcactggtatccggtttacagaaagactataccggcaaaatcactcttctgaacagactggtcggcaaatatccttcttctccatacgcagtgaatgctatttacgagaaaggacgttcttatgtactgatggataacaacggtcaggctattacttctttcaaggaattgctggagaaatatcccgaaagccccgtcagccggaaagctgcggctgaaatcggtttgctgtattatcagaacggcaatttcgaccaggcaatcaatgcgtacaaacaagtgattgagaaatatccgggcagcgaagaagcccgcctggcaatgcgcgatatgaaatctatctatgtagacttgaaccgtatcgatgaatttgcggctttagccaatgcgatgccgggacacatccgctttgacgccagcgaacaggattcgcttacttatgcggctgccgaaaagatttatgcacgtggcagaacagaagaagccaagagcagccttaataaatatctgcaaactttcccagaaggagcatttagcctgaatgcacattattacctctgccagattggaaatgagcagaagaattatgatatggtgctcctccactccggaaaattgcttgaatatccgaataatccattcgcagaagaagcgctgatcatgcgtgcggaagtacagttcaaccagcaacagatggcagaagctctggcaagctacaagatgctgaaagaaaaagcgaccaatgtagaacgccgccagcttgccgaaaccggcatcctgcgctgtgccttcctgctgagagacgacgtagaaacgattcacgcggctaccgaggtgctggctgaagccaagcttagtccggaactgaaaaacgaagctctttattatcgcgcaaaagcttataagaatcagaaagcggacaagaaagcattggatgatttccgcgaactggccaaggatacccgtaattcttatggtgccgaagctaaataccaggttgcccaagcactttacgatgccaaagaatatgcggcggcagaaaaagagctgctcaactacatcgaacagagtacgccacacgcttattggctggcacgcagctttgtcctcctgtcggacgtatatgtcgctatgggtaaagacctcgacgcacgccagtatctgctgagtctgcaacagaattaccagggcaatgacgatatcgagagcatgattgaagacagactaaagaaactaaacaagtaaagattgaaaagtatgaaacgaactctttatatagcaggaggctttacactggcatttctgatgccgttcaacctccaggcacagaatactcagccgaaagatacgaccatgaaccgcacggtcgtcgtagaacaggaatataatcccgacattctggatgcttccaaagtgaatgtgctacccaaagtggaagaacctaccgtcagcaaaaaggaagtggaatatgccactactttcttcccggctacctctatccctgccgacctgatgcgtccctatgtaggaacggaagtgcagcccggcagcaagcccggatatatacgcgccggatatggaaactacggtaatctggatctccttgccaattacctgttccgtctgtcggacagggacaagttgaacgtccgctttcagatggacggaatggatggcaaactgactatgccggaagcagacacgaaatggaacgcttattattaccgtacccgtgcgaatatcgattatatccaccagttcaacaaggtagatttcaacatcgccgctaatttcggactcagcaatttcaacctttctccggttcagcccggcaagcagaagtttacttcaggagacttccatctgggagtaaaatcgacagatgaaaattatcccatacagttcgaagcggaaaccaatctgatgatgtacaaccgtcagaacaataacactttctttttcaatgacaaagtcggagaaacacaagtgcataccaaaggattgatcagcggcgctatcagcgacgaacagagcatcaacatcggattggacatgcgtaatctcatctacaataaagacctgaaacttgctgacgacctccaggtatatgagaaccgtaccgctctggcactgaatccgcattataaacttagcagcgacagctggaatctgcgtgcaggagccaatgtagatctctcattcggcagcggtaaatcattccgcgtgtctccggatgtaacagcacagtatatcttctccgacagctacgtactctatgcgcaagctaccggaggcaagctggtcaacgatttccgcagactggaaacgatctgtccttatgccttgccggcagcccctattcttgatacatacgaacagctgaatgcagcgataggatttaaagcgagtccttatcccggattatggatcaatctgtatggcggttatcaggatttgaaagacgatttctttgaggtacaggaagaaacatttgtcaactatgatccctcacttgccggtgatgctcaggaagggaattcctcgtctccggtcacagcacatcaatatctgaatctggaattcagcaataccaacaacttctacgccggtatgaagatcagctatgaatacaaagacctcattgcattgtccgctgctggaacttaccgtaactgggatgcgaaagaaaaatacagcctgtatatgaaacccgcctgcgaaattaatttcagcgcagacttccgcccgatcacaggactgaatatcaatctcggttacgattatatcggacgcacaaaggtagaaggcattaaagccgcagcagtcagcgacctgcatgccggagccagctataatgtgttcaaaggagtatccgtgtatgcccggattaataatatcctcaataagaaataccagtattatctgggctatcctacagaaggtcttaacttcctgggaggattaagcttcagcttctagacaagacatattctccaaagagaagaaccaatcagatgcccatcctgttattgcctatgtgcaatataacaggatgggctttttcattgttccttacaaagcctccttttccatcccgtctataattttgtatcaaggtctacccatttgttacagatagtgtttctagctatttgtgcacctaatttggtgaatattgcacgttcatttttcacatcgcccctaattttgcatcatcattaaaagataaatgaagttaaccttattgcacataagcacaaggatatatttagaaactgaagagaaaataaagagaataaaagtcaccccaacccggttgacctaactataaactaaatatattattaacctatcaaattaaacagtatgagaaacgcgctcaatttaagattctgctttcttgttacgtttcttttattcataccgttgatgtatgccttgcccccagaaggtatcacaattaagggtagagtaacggatgaaacactcaaagaaggcgttcccggagctaatgtgactgtgaaaggcacgagcattgggacaatcacagactttgacggtaactttacgatcgtcgccccaagcaaaaaatccgtattgaacatttcctttatcgggtatgtaactcaggaaatcgtggtcggagacagaacaatcatcaatgtttccttaaaagaagatgcacagaacctcggtgaagtggaagttgtagctatcgcatacggtaatcaggacaagcgcatgcttaccagtgccgtctcctccattgacaacaaagagctgatcaaatctccggcaacaagtatcacgaacctcctcgcaggagcactgccgggtgtatcttccgtacagactaccggacagcctggtaaagatgctgctgccatctacgtacgtggtgtcggttcattaaatgattcacaatccaagcccctggttttagtagacggaatagaacgtgagttttcacaaatcgacccgaacgaaatcgaaagtatttcagtattgaaagacgcctcttccaccgctgtattcggagtaagaggtgctaatggcgttgtattgatcaccacccgaagaggtaaagcaggcaaaacgcagatttccgccagcaccaaactgggtctgcaacaacccatctcactggtagagcagaccggaagttacgagttcgcacgcttctggaatatgaagcaggagatggaccacgttacgaatcctaagttatacttcactccggaacaggtagaagcctatcgcaccggctcagaccccatcatgtatcccagtatggactggaagaagtatatttttaataatatctatcttcaaagccagaacaacctaaatatctccggcggtagcgataatgtacgatacttcatctcagtaggttatacttatcagaacggacttctgaaagaacttcccggacaaatgtacgacaataactatcgttacaaccgctataactaccgcgccaatatcgatgccaatctgaccaagaccacttcgatgaaactcggtgtcggtggtgttttaggtaagatacaggaaccgcgcagcgtcgtttcgggtacaggagaagaccaaaacccctgggtaatcgcacagatctggtcacatccgtttgccggaccgggatttatcaacggagtacgtacactgattcctaaagatatggttccgctgggagaagtgatgcgtgacggtatgttcgtattctacggacaaggttacaatcaaacgtatgacacgacattgaatctggatttggacatcacacagaaactggactttatcactccgggactgagcgtttccgtgaaaggtgcttacgacaataaattcaaactggaaaaagtacgtacgggaggcgccatcgaagcgcagactgtgtactacaaatcatactttgacaccaacggtacgatgtcacagaccgatcccgactacgataaatcacttatctatgtacccagcggcagcgatactccgctcacttactcggaaagcagcggacgcggacagaactggtatctggaaggacgtatcaactatgaccgtacattcggcgaccacagaatatccggtctgttcctttacaatcagtcgcgtaactattatccggacagctacacttatctgccccgtaactacgtaggattggtaggacgtgctacttacgcctatcaaagtaaatatctgctcgacgtaaacgtcggctacaacggttcggagaactttgctccgggcagcacacgtttcggtgtattcccttccttctctgccggatggatcgcaactgccgagaagtttatggaaaaccaaaaaatcgtagactacctaaaactcagagcatcctggggacgtgtaggtaacgacaagggagtagactcacgctttatgtacatgcctgccgtatggggatcatcgggcagttacagcttcggtgtggacaatccgatttcccaatcggcagcagccatctcacgtatgggtaacccggcagtaacctgggaaacagccgacaagcagaactacggtattgatcttaagttcttcaacagccgcctgtccgctaccttcgactactttatcgaacaccgcacaggtattctgatctctccggaatcgaccccaagcatcatcgcaactgcactgcctaacctgaacattggtaaggtagacaaccacggttacgaagtttctctcggctggcgcgataagatcggaaaggatttcacctataatgtggatgccaacgtctctttcgcacgcaacaaaatcctctatatggacgaagtgcccaagcaattctcttatatgaaccagaccggtggctctaccggacgccagaccggagtatacaactacatccgtctctatcagtacagcgacttcatcaccggagccgacggcgaactgaccttaaagccggaactgcctcagccttatcagaaggtatatccgggtgacgccatgtacgccgacctcaacggagaccacatcgtggacggtaatgacaagagcgtagcaggttatgctacccgtccggaatacgttttcggtatgaacatgggattcgactggaaaggattcaatttcaccatgcaatgggtgggttccaagaacgttaacagaatgtatgacatcgaataccgtatcccttatacgaatgccggaaagcgtggtttgctgacttacttctacgacggttgctggactccggaaaaccaactgggagctgtttatccacgtccatcagaagaatcggaaagctggaactccgaaccctctaccctctggttggtggatgcttcctatctccgcttgaagagcctgagcttcggttataccatcaccggaaagaaattcctgaagaaactgggcctcagctcactcggattaaacttcagcggctacaacctgctgaccttctcaccgcttaaatatcttgatccggaaagtgatcctaaccgattcggagattatccgctgatcaaagtatatagcttcggtttaaatcttaacttctaaaaaacgactgtatgaatagaataataaaaggactcggaatagcattgggttgcgtactgatagcctcctcctgttctgaaatcagcttcggggataaatttctgggcgaccagcctgagagttccggagcgactaccgaagaaatgttctcttcgaaaataaatgccgaaaaggtgctgaccaaagcatataccggattaccttatgggctaccgaccggctctgactacaaattgggtgtgaacatacttgaatcaatcacagacttatgttacagtttccgtgacaatatcagtgatgggcctgtcaagctctattacaacggagcactcagtgccaacaacgtcccaaagaattctgcttaccgttatggaagcaagtctgactggaccaccatccgttacgcttggttatatatcgagaacgtagagaaagtgcccgacatgacagccagcgagaaaagtgaacggatcgcggaagccaaagttttgatctccctctgctatttcgaaatgctgagatatgtaggcggtgtgacatggctggaccactatgtagacgtaaacgagacaatgaatttcccccgtatcacttttgccgaaacggtagagaagatcgtaggattgctcaacgaagccatcaactccaatctggcctggaaagccgagaaagcagatgacggacgtatgaccctggcaggagcgatggcattaaagttcaaggtattgcaatgggcagccagtccgactttcaactcaaacaccaaatggcatccggaagcagacgaatatacctgttacggaaattacagcgaccaacgatggaaagatgccgccgaagcaggcgcagcctttttcacagaattacaaaaacggcacgaatacgaactgattcaacctacggaagagacgcaccgggcaagacgtctggcctatcgtcaggcctactacaaccgcggcggaacagaaatattaatctctacccgtcaaggatatggctccgatgttcacagcagctttatcggccaacgttattacagcggccctacattgaactatgtagatatgtttccgtgggaagacggaactgattttccggcaaatttcgactggaagtccccctccaagcaaccgttctttacaaaaggcgaaatggtgcccacccgcgacccgcgtctgtatgaaaatgtagcttgtcccggagacacctactgtaacggaacaaccgctcctgtttatatcaaccacgccgactacaaagacggtagcggattcctgatcatgaagtacattttacaggaaaacaacgaccgcgaaggtccggtacaatggtcacacacccgtctggcggaaatcatgctgggatatgcggaagtactcaacgaagtcaacggacgccctaccgacgaagcttacaaaatggtaaacgatgtacgaaagagagtaggtctgccggaactttccaagacgatgaatcacgatcagttcctcgaagccgtactgagagaaagagcactcgaattaggatttgaagaagtacgctggttcgacctcgttcgcagagaccgtcagagcgacttcaagaagaagttgtacggactcagaagcagaggtaacgacctgaacaatccgactgagttcaccttcgagaagatcgaactgggagaccattactgggctaccaactgggataccaagtggtatctggctccgattcctcaggaggaaatcaacaagcaatatggaatgacccaaaacccgggctggtaaatgacacgttaactaatatcgtttgaacaatgaataaaataaattatatattaatcactctgctcctgggaggttcggtatccctgaatgcacagacatccaaagctgcttcggaaatgcagctggcagatacactgagcatcggctaccagatgaacgtatcttcccggaccagcagttactctatcaacggagtcaatgcttccgcattcgaaaaatccccgtacatagatatcagcaaagctttgtatggaaaagtggcaggtctgaatgtatatcagggtacaggctcgtcagccgataacgtatccaccctctctatacacggaaatgccccgctagtattaattgatggtttcccacgtgatatcagtgacatcacttcgatggaaatcgaatcatgctacgttctgaaagatgcggcagccgctgctctctacggtatgcgtggtgcgaatggagtagtactgattacgactaaacgcggaataagcaatggtctgaaggtaaatgtggactataatttcggtgtcaatacccaattccgttctccggacttcgcagatgcctatacgtatgcgaacgctcttaacaccgcattaagcggagacggtctgcctgcacgctacaatgcacaggaactggatgctttccggacaggaatctatccgtatgactatccgaatgtagactggtggaatgaaacgctgaacaacacaggattgacccacaacctgaaaatgtctttcagcggaggtagtgacaagttccgtttttacacggtagttgactattaccgggatcgctccatgttgaagaaaaacacggaagatacacgtttcgacactacacctacagacacacgtctgaccgtgcgtaccaatctggacgtaaaagtgacggaaagcacattgctgaaagccggtatcgtgggcagactgcaagaattcagaggtacccgctatggacgcaacgctattttcaacaaaatctatggcattccatccgctgcattccccattcgttatgagaatggcatttatggaggtagctctgtgtacggaaccggtaatccggtagctctgttgaaagactacggacacatccgtaacgtatacggaacactactcgccgacctaagcatccgtcaggatttaagtgcgttgaccaaagggctggcagccgaagcatccgtctctttcgataatatcggaggaatgaatgaaaccaccaataaagagtatcgttacatgaacagcaatgcaagtatcaccagcgatggtacactggtgacaactcctgccatttatggtacagactccgaaacactgggacatacacagcctttcgaaaggctgatgctacgcagcgatttccaggcaaaggtggattataaccgcacttttggcaaacatcaggtgggaggagcattgatttatgatatgcagtctgttgtcaaaaacggcagaaacaactctcagaagaatcagtctgtgctggtgaacgccacatatacttacgacaaccgttacagcctcaatgccgtatttaaccgttcgggatcagcttacctgcccgacggagacaaatactcgaactatcctgccgtttccgctgcatggatcgtttccaacgaagcatttatggaaaaggtgacaccgatcaatctctttaagattcgcgcctcttacggtctgtccggatgggacggcaatctgagccacgaactatggcgtcagtcttatggcagcggcggtgccggttataacttcggagtgaatgccggaggacagtccggtggcagtgaaggcgatctgccggttatcggcctggtagcggaaaaatcacagaaagcgactttcggatttgatctcgctgcttttgataatcgtttgaatgcaacagtagaaggtttctacgaaaaacgttcggatatacttgtgtcaggtgccaattctacttccggtattatcggtatcacagtaggtcaggtgaacgaaggaatctataaatacaaaggagtggatgcttctttgagttggaatgataagatcggtgatttccattatggtattggtgctagcatgtcatatctgaatacagaggtagtcaatgtaaaccaggcatatcaggaatacgactacttgtataccaagggcaaccgtatcggacagatgtacggcctggaagctatcggcttcttcaacagccagcaggaaatcaacaacagtccgcaacaaaccttctcggacgtagctcccggtgacgtgaaatacaaagatcagaacggtgacaaccgcatcgacgagaaagacattgtgaaaatgttcggttcatctgttccacgcttctatttcggattcaatctgaacttctcatacaagagactggagctttccgctgatttccagggaatgaccggagtcactgtttcattgctcaacagtccgctttatagtccacttgtaagcaatggcaacatttcaaatacattcctgaatgaagaaataaactggacaccggagaataagaccaatgcaaccatgccgagactgactactcaagaaaacttgaataactatcgcgccagctcactgtggtaccgtgacggttcattcctgaaactgcgtaacctattggtagcttatactttcccgaaatcgcagactcgctttgccgacctgaaagtattcgtacaaggcaccaatctgttctcattagacaatatccattttgccgatccggaacaacttggcatcgcttatccgtcgacaagaagttattgggcaggtatcaaacttaatttttaatgcaaagtaacaaatgaacattatgagaaccaaatacatactcttaaccattttgtcttcgttggtctttgcttcgtgcaactaccttgactttgatgaaacgaacaacctgaagacaaaagaagacatgtacaagtatttcggtacaagcaaatcaatgcttacccacgtatactcatacatgccacaaggctaccaactgtttgcgacctccggcggaattttcaccgaagacagatattccatgcgcgactgtgccagtgatgacggcgaattcggagcctatgcagataatatccagaataccaataacggtaactggtcgcctattaaaacttatgacgattcatggaccctgtatcgcggtatacgtgctgccaacagctttatagcagagattgcccaagtggacttcacacgctacgagcacgacggacaatatacaaactggatgaagcagctgaaatatttcccttacgaagccagagtgctgcgggcacactacttctttgaactggcacgccgctacggtgacatcgccatgccattggaagtactgactgaagaggaagccaatacaatcggcaagacaccattcagcgaagttatcagcttcattgtcagtgaatgcgacgacgctgccaataacttgccggacagctatgtaaacgaaccgggagcagaaatcggcagagtgaccaaaggctttgcaatggcagtaaagtcaaaagcactgctatatgctgccagtaagctacataatccttctatggataccgaattgtggaaaaagtctgccaaagcagcaatagatattatcaacacagggctttactctctcgacccccaggagagtgccaacaacctcgactcaaaagaagttgtactgatgaggatcaatggtgatgactcggacttcgaaatgtttaatctcccgcttcgcatgactgcgggaacacgcacttccagtcttatcccatacagcaattacccatcacaaaaccttgtggacgcattcgagacagtcaacggttacaaagtaaccctagaaaacacaggatgggtttgcgaagaccctgcatttgacccgcaatcaccttatgagaatcgtgacaaacgtttctaccgcgctattcttgccaacggaatgtcgtttaaagactacaccattgaaaccttcaaaggtggcgccgacgacggaatcgtatcacaaggcggttcaccgacaggatacttcctgcgcaagtacattcaggaagctactagctttgaaccgggtaaagaagctgtcagcaagcatcattgggtgatttaccgctatgcggaaacattactaacgtatgcggaatctatggtcaacgctttcaatgatgtcaattacacagatgagacttataagtattctgctctgtgggctatcaatgaagtgagaaagaatgccgatatgccgttgattccttccatgggaaaagatgaattcatggaacgcctgtacaatgaatggcgtgtagagtttgctttcgaagatcatcgtttctgggatgtacggagatggaagattgccgatactacccagcgggaactatacggagtaaagatcgagaagcaggcggacggtacgttcaacttctacaagaacctttacgaaacccgtaactggagagattgcatgtatctgtatccgatccctcaaagcgaactatacaagaatacaaacttaaatcctcaaaacacaggatggtaattaattgtctaatctaatatttaaaagatatatgaaaaagttatatagcaacacgttaatgcaactgattctcgcactgtgcacattcagttttgtagcatgccaggagttcgacatcgactcacagccggaaggccctctcaatatccagatagatgctctggagtcttacactgctttggcaacttctccaagcaatgtagttttcaacatcagctccaacactccctggacgatcgaaagcgaccagcagtggtgtaagccgactccttcgatgagtgcagccagttcattggtgtcggagattgtggtgacaatggaaaacaatacaggaaagaaagcacgtacagccaaactgactatcaaggcagaaggcgttgaaggcactaaggtagttactatcgagcaggcttcgaaagaagacttggtggtggttccttacgatgaactggtaccgacagaaggcggcagcatcacctttaccattgcttccaacaaagcttgggaaatcattccttccaccgctttcctttccaatatcgacaaaacatccggtacaggtaatgaagatgccatagcagaaaccgtaactgtgacactgcccgccaatgcaggtgccaagagagcaggcacgctgactgtaaaaacagagtttgaagaatacacctttaccattactcagaatggagtgatcattgaactggaagaagatcccgaaagtacaacaatcagcatgcccggaacaggcagtggtatggaaaagactgtactgattcgcgcaaacaaagaatggaaagttgaagttcctaagaaatatcagagttggctgaaagctgaggcactgagtgaaacagagttgaaagtaacgacaacaacgactaataatctgatggtaaaccgtgtcggccacatcattatgaagaccaaagaagtcatcgacggatttgacggcattacgttcgacatcagtcaaggtactgctttctggaaagaaggaggagcagataactatgttgtggatgaggaaaccggttacatgacactctatggcagtggaatagtcaccaactatttattcaaaaaaggacgtctcgcattcgatttcgaatctatcaatttaaccggagaagattggattgagtttaatatgtggcccaactcaggaaatacaaacttccatttgcatttctacgcaaataaagaaagtaacttcacttgtggaggttcaggcttaaactggactcagaaaacatttacctggacatcggaacaaacgaatgtagtgaagaagattgaattccttgttgtcaacaaagaagaaggttcgaacgcattagttcttaaactgattattgatggtgttgaggttgccgtattagataataacataaccgatccttatgcaaccgaaccgggagcacctgtatacttcaggatgcataccacaaataaagcttccaatttcaccgtgaagtctatcacatgggaaccagtagaataataaccgaaccctaaaattcaagagtatgagattaaatatcagaaaatcaataattacaggcatttctctcgctacattgctacctgcattctctttattgcagagttgcgatgacagtgaagcagagaaatgggtagacctgcgctatagagtagaagactcctatctggttgaagcgaaaaatccggaaccagtctccttccaggtcaagtcaactgacccgtgggaagtattcggaaaatatgattggtacaccatctcacccagtacaggtgaggcaggtgagacctacaccgtaactgttacctgcaaagaaaacactgaattggacgaccgtatagacacactcaacattaaaagtgactactggaccggaaaaagattcgttctgacccagaaaggtactgcttacctgaatgtagaaggcgtggatatgatcgaccaggaaggaaacagcgaaacattcagcgtactcagcaatcagaaatggactgctaaagtaacagacggtgatgtttggctctccatccaatccggagcatcgggcgaaatgaacggagaaattactgtcaccgcttcaccgaatacaggcgaacaacgtaccggtattgtaaccatctatgaccgacacgggaaaatagccagagaagtacaatgtatacaagacggtgtattgctgacaccagatacaccggaaaacggtaagtggtttgctatgtatgaacaggctcagcaactcaccatccacgtagaatcgaatgcagaatgggaagtatccaaagaaaacgaagcggatgatacctggtatcacttcgaaaagacttcattcgacggttctgccgacatcgtgattaacgtagacgcacacgaaggctcttctgtccgtaccggaattatcgtactgagcaccaaagctgccgaaggcgctactccgcttatgaagacaatcaagattaaacaagcgaatccacaaagacctgtggttactgaagtaaacagatccatcagcggtgcttactacggaccgggtggtttaatgccgggtcattacagcttctattgggaaccgcttggcgacgccagtctgactactttcttctcttggagcggaaaagcatttgacggaggagacgtagaacttcgcttccatattctgagcaaacggactcaattaagtacaagaccgtggaacggtgacgtatacaatgagaacagcggccgtgatgtagataccagcaagccaaacgtattatcattcgagatacgcgaagctatagatgccaatgatccaactcaatcatggatttactcggaatggattctcaacggtacagtcataggaaaagcaaccagcgacggtgtgatagacgctaatggtacaagtgatacttacaaagtaccattctcggataccaaagatggtggtaatttctcgatgacaatttctggcggcagtgccacactgactaaatgggaatacatcgctccactagtatggggagactaattctctaaggatagtgattgcctgaactcccccaatcaggcaatcgcttctaacaaactcaaaaatcaataaaaagaaaagagtatgatgaaaagaaaaatattacttatactgaacatggcaatcatcggattttccactgctgcctgttcggatgatgagaccaattacatcactccggaaaagaaatatccgctcactgattttgccgtagcagtaaataatgtgtcagcgaatacgacttcctattatcatgggaagatagaccagacaacccacagagtggaaatcggtacgatcgaggatgccaataccatcaccggcgtagactatacgctaatgagcgatggagccaccatctcaccggacccggcaacatttgtacacaactggaaaaaagagcagacagtgaccgtcaccaccgaagacaatcaaacaacgacctatactatcgtactgaccaagtttgacgacaccatgaaggacgttctcttcatggacgagttcgatgtggacggcaatccggacccgaccaaatgggtactctgccagaaagcaggctccgactggaacgacgaaatgtccgaaagttatgaccaggcttacgtaaaagacggcagacttatactgaaagccgaaaaaataggtgatgaatacaaagccggcggtatcgaaacgcaaggtaagtttgacttcaccttcggacgggtggaagtaaaagccaaaatcaccagttaccccaatggcgcattccccgctatctggatgatgccgaagaaatatatctatgacggatggccgaattgcggagaaatcgatatcatggaacatgtgaaacaggaatccgcgatccatcatacgatacatactcactacacgtatgatttgaacatcaaagatccgtccaacaccgcacaagtaacttgcaattatcaggactggaacatctacgctttagaatggagcgaagacaaactgactttcttcgtcaatggacaggagactttctcttattcaaacctgaaactggagaatgaagcagaaatgaagcaatggccgttcacaaaagattcttcattctatctcatcctgaacatgggattaggaggagacagaccgggctcatgggcaggtcctatcgatgatgccaacttacctgccatcatggaaattgactgggtaaaaataaccaagttagataaataggttttaaggtaggagccaaggtttttaggaacttctaaagaaggaggaatggaagtatagagactattcaaaactttcattcctctatttgttttcgggtattaaatcttttttacttattaaacatgaaacatttattatacgcattattaacggctgtaagcattttattcactagttgcggaccctcttccaataccaacaccccacaggagcccaatgtgcctcaaccgcagcctcagccccaaccggaagtcacccagaaagtagttatcggttaccttgcgcttgacgactgggagtttgaaaatttatttcctacgatagaatggaaatatctgacgcatatcaatgccagctttgcaagggtaaaagcagacggcactctaaacattaatcctgtccggaagagaattgaaagtgtacgtgaaacggctcacaagcataatgtcaagattctgatatctttggctaagaacagtccgggagaattcactaccgccatcaatgatccgaaagccagaaaagaactgatacagcagattattgcattcactaaagaatataaactggacggcttcgacatcgattatgaggaatatgacaactgggataagaatttcccctcattattggtttttgccagaggtttatacctggcaaaagagaaaaatatgctgatgacctgtgccgtcaacagccgctggcttaattacggaaccgaatgggagcaatacttcgactatatcaacctgatgagttatgaccggggagcgtttaccgataaaccggtccagcatgcttcatacgatgactttgtgaaagacctcaaatactggaatgaacaatgtcgggcatccaaaagtaaaatagtgggaggacttcctttttatggatattcctgggaggaaagtctgcaaggcgcagtggatgacgttcgtggaatccgctatagcggcatactcaaacatcttggaaatgaagcagcggacaaggataatataggcaagacttattataacggccgccctactatagccaacaaatgtaagttcatcaaagaaaacgactatgccggcgtgatgatctggcaattatttcaagatgcccacaatgataactatgacttaaagctcataaacgttgtaggcagagaaatgatggaatagacgagatatatcgctttctcttatgcagaagaccctatcctgttgtgcttttcacctattgttatcagatttttaataggagatcttcatcgttccactcgagtgatctgatctcatcactagagtgaacagatttctccactctagtggcaagatcgtttcacccgggtggaacgatgaagatgtcggtaagaaaacataagtatataggcttgatatggcaaagatataaggtatccgagctacaaagtacctgttatttgaaactgacatatgagatattaaccctcaaaaggtagacagttttacctacttacgcaaggaaagggaatgagagatgctttgaaaaaggatgagagataagctaaattgaaggcattttgcgtagaaaacaatgagagataccttatagaagaagtatctctcattgtatatcacactgattatatgctatttacctcatatagaatgagagtatgagactaatatttatttttttatttctagtatatgttcctaagttcaagttatcaatgcgatttacttatcctgcttcctataagcggaaggaatctctcctttaatagacttgaaaaccttactgaaataacgcaaagaagagaagccgaccacttcggagatttcagtaatgttcatggtagtagtagtaagtaacacgattgactgctcaatgcgctgcttattcacatagtctacaatccccatacccgtgatggccttcactttattgaataataacgaacgactgatacacatattagtagctataaacgcaacatccagatccggattactcatattatccgcaatcaatgtattcaatttcagcaggaaagtctcatccgcattactaaagctcacttccttatgcgtcaagagcttatcatctttatatcttgcccgtatctgttcgcgctgcctcaactgattatgaatcaatgccagcaaaccgtctatttcgaaaggtttcggcaaaaaggcgtccgctccagtcttataaccggtatacatattctgagaattatgataggcggtcaataagacaaaaggaatatggctgatatccagattagtcttcacttcccggcaaagttcaaacccattcatccggggcatcatgacatcactgatgataatatccggcaatcggtctttgatctgttccaatccctctttcccatccttggcaacatatacacgggcaaaataattactcagcgtttctttcagataacttcgcagttcgggagtatcttcgaccaccatcactgaatattttttcaggaaggtataatcgattctatccggttcattcacttccacgcctgtagctgcttccacagaagccggttccagctgtccgcaagtatccgtgaataagggtagttcaaaataaaagatggccccttttcccgctgcattcgaagcgcccactcttcctttatggtgtgtgatgagactcttcgcataggataatccgatgccgcttcctcctttttcatgtcccccctgatagaaactggagaaaagagagtctgtgtctaccatattcagtcccatcccttcatccctgacagagatccgaacccagtctttctcttgtgacaaggtggtaatcagtgtagtagtggtgcccgattcgctaaacttcaacgcattcatcaggaagttagaaagaacgaactcgcacttattctgatcgaaaggtacctcttttatctgttcgtccaactcatattcgagtctgatacctttcacatgaaactcattgatgaacttatctccgacagagcgcacccactcattcaaaggatgcggcaatatatgcagcatatcttttccttcttccagtttccttacatcaagtaccatatcaataatattcttcatctgatatgcctgcttatagatcgggaccaacaacttttccacatcctgcttgtccgactcctgattgataatacgcttcaatggtgcacaaatcagtgtaagaggagtgcgaagttcatgactgatgttcgtcaggaaattaatcttttcttcatacatcttatttttcagacgcataatctcccgcttctgtttggctttcttcttgcgatagaagtagtagacaatgctataagccactgctcccaacaatatatataatcccacatagaaccaaccggtcttccaccaaggcggagtaaccacaacatgcagaatgggttgtttcatactccaccctccgtcacgggtataataagaagcggtaatcgtatactcccctatcggcagataattgataaccaaagagtttgaattggaactcgccaattcctgatcgagcccctctatattgaaacgaaagaaattcttgcggaacacatcgctttcattcagcagaactttcagttgcagggaagaaaagttccagggaatctgaattgtttcagccgcttcctgcggctcttcggataacgagacaggcagaccgtttaataatacatccagcagttcgaccgtataatcctcatctgtatcaaaatgaacggcagagtttatcaccgtcatgcctgtagttccaccgacaaaaacatctctgtttttggccagaagagtagcatgaaagatgtattcgttaggcaaaactccatctacttcctccaaggtagtaaaattatgggtacgggaagaataaacaaataaatgacgtctcgttcctatccagattcgatattgattatcggcaacaacagaagctacatcctgaaacaggcttgtatttatcagttcactcttccctgtccgtggatcataacgtaccaaaccttcggtagaagccagccaaaaaataccatcctgatccatagaggcgtcattgatagtgtattgtccttgataaatcgtccggaaagtcccttccgaagaatcatactcacaaatattcttcagatcggaaaggtatgtctttgcacctttcgtagctattatcagtggagaatgacgctcgtactcttctcccatagtagccactatatcaaatttacgggtgaccatatcatatataaaaatatgctgggcactgaaaagaattttagtcttcgttatccgctggatattgacagaaaaaccattgatacaggtctgatcattcatttccttgtcaatcagcacaaagggacgtatctgccccgttttcttatgaaagataaagagtcctttattaaaggagaagaacaacagttcgtcaggagtatattccacaatggagacaactttctcatatttggtggcaggataatgtttgaaggtacccgataccggatcaaaccggttgatacctcccccatcagttcccacccagactattccgtcactatcctgaaagaaactattaatagtctggttgcttaatccgtacagattgccaaaaggaacgttctgataagaacaggcatacacattctttataccaatcaaccctcttctgatactgcctgcccacatattattggccgggtccagatagaggcggtatatagtattggctggaaaggaatgaacatcatcctgtttttgttgaatattagtaaatgagaaatcatctaaagagattatattgattccaccaccatcagtggctacccaaagctgattatctctctccatgatatcatgaatgacatcatacgtcaaaggagaatttgacgccgtaaagtgttttatcaactggtctccctgatagcaatacagtccgttaccataaacacttacccacagacgcttgtaggagtccagatagatactggtatagttattttctgtaaacgactctattttcttcacttcatacgtcttcatattgaaggaatatatgccgtgccaacgtgaattgagcaggatattctcttcatcataacgtatcatctgccaaaagggattgtaataaacagggtcttgcgcataatacaaaggttccagcttattagtggcatagacatatttgtatatagctcctgatcctcccagtaagattcctccttcaaccaataaataggaagcaacatagatcggtttaccattattcgataaagttctgaaactatcactccctctgtcgtaaaggcaaatgccgttcatcgtagctacccatagattgcataaagagtcctcggcgataaaagtgatattgttggaaggcagtgttctttcatctcccggccgatgcagatattgcttcagatggtcacggtcataacaattcaaaccggattccgtaccaatccaaagatacccccgatgatcattcagaacacattgtactttcgactgtgagagtccttcctttattccgagttgtttgtaataataataaggagactggctcaatataggttgtgcaatacctacaaagaaaaacaatagatatattttaaatagaatctttctcataaatagccacataatactgtacaaaggtgtaaatataggaaattctatttaaataaaactgttttatattaatttccccttaattatagaacatttctttaataatacttgcacatacaaaagaaatgcagatttactcaaaacctatttttttccaaaaaaatattagtttctccttatattataaggtagggcgaatctttttttttacttttgccccgaaatattatggtacaagccattataaaagaaagaattatgcaaaaaaaccttgtcattgtcgagtctccggcaaaagcaaaaacgattgaaaaatttctcgggaaagatttcaaagtcctttctagttacggacatatacgtgatctgaagaagaaagaattcagtatcgacgtagataagaattttaaacccgattatgaaattccggcagacaaaaaggctttggtcagcacgctgaaagcagaagctaaagaggcagaaaccgtatggctcgcatccgatgaggaccgcgagggagaagctattgcctggcatctgtatgaagtattaaaactaaaaccggaaaacacaaagcgaatcgtatttcacgaaattaccaaaggtgctattttaaaagcaatcgagcaaccacgcaatatcgacctcaacctcgtaaatgcacagcaggcacgacgaatcctggatagaattgtaggttttgaattgtctcctgtactttggagaaaagttaaaccatctctgtcggcaggacgcgtacagtcggtagctgtccgcctgattgtagaacgtgaacgcgaaattcatgcgttcaaatcagaagccgcttaccgggttattgccatattcctggttcccgatacagacggcaagctggtagaaatgaaagcggaactgtcacgccgtatcaagacgaaagaagaagcaaaagcattccttgacgcatgtaagggagcgacttttacgattgaagatataaccacccgtccggtaaagaaaacaccgccggctccattcacaacttccaccctgcaacaggaagcggcacgcaaactgggatataccgtagcacaaacgatgatgatcgcacaacgtttgtacgaatccggatttatcacttatatgcgtacggactccgtcaacctgtcggaatatgcaacagccagcagcaaagacgctatcatacagatgatgggcgaacgctatgtacatccgcgccacttcgaaacaaagacgaagggagcacaggaagcgcacgaagccattcgtccgacttacatggaaaatcaatccatagaaggcacagcacaggaaaagaaactgtatgatctgatctggaagcgcaccatcgcatcacaaatggcggatgcggaactggaaaagactactgctactatctctataagcaaaagcggtgatgcattcactgccatcggcgaagttatcaagttcgatggtttcctacgtgtataccgtgagtcttacgacgatgagaatgaacaggaagatgagagccgtctgttgcctcctttaaaaaaaggccagaaactggaatatggacctatcgttgccactgaacgtttcactcaacgcccgccacgctatacggaagcaagccttgtacgtaaactggaagagctgggtatcggtcgtccgtccacatacgctcctacgatttctactattcagcaacgcgaatatgtggaaaaaggaaataaagacggtgaagagcgtacatttaatgtgctgacactgaaagacaatcagattaaagatgaaagtcacaatgaagtgacgggagcagaaaagtcgaaactctttcctacagatacaggaactgtggtgaatgacttccttaccgaatacttcccggatattctggattacaactttaccgccagtgtagaaaaggaatttgacgaaatagcggaaggagaagtaaaatggacttcgatcatgaagactttctatgatcagttccatccggcagtagagaagacattatccataaagacagaacataaagtcggcgaacgtatgctgggagaagaaccggaaacaggcaagcctgtatctgtgaaaatcggtcgtttcggccctgtagtacagatcggtgccgcagatgatgaagagaagcctcgctttgcccagatgaagaaagggcagtccatggagaccattaccctagaggaagcgctggaactgttcaagctaccgcgtactttaggtgagtatgaaggaaagactgtcactgtaggtataggtcgctttggtccttacatccagcataacaaggtatatgtatcactgccgaaaacacttgatccgatgaaagttactctggaagaagcagagcagctgattctggaaaaacggacgaaagaagcagaacgccatatcaaaaaatttgatgaagaaccggaactggagattctgaatggtcggtacggaccttacattgcatacaaaggtaataattacaagatccctaaagacattgttcctcaagatctgagtttgaagagttgcttcgatctaatcaaaatacaagatgagaaaggtcctggcacttctgccaaaggtaaacgaaccgcaaaaaagaaataatatttgcatccaatgagacatcaaagtccggtaacctatatcaactggttaccggacttttgttgtatttaccatgctatatatttctttttaaacgatttatttcctaactctttgttttgatatattaaatgcatacatttgcgggtcacaatcaaattatcagaacacagttatgcaaacaaacaatttcaaatctctctcaatgggggtactatgcgcactctcgttagccagttgtatggaaaaggacttatatcaggctccagaagaaaaaactgcagatgaatactttggctttacaacatcctccagttgcacagttgatttaaactatggtttaaattatcaggttgtttttgagttatatgccgaaaatccgctatcggaagataaggatggaaacattatcaagacaaaagaagagcctgtctatcgcggggctacggataaaaaaggaatctttaatgatttcatatctattccgtcttatcttacagaactttacctttattcagactatcttggaactgtcagcccgattcagctacaaattacaaacggaaaagtatcttttgatcagcaagcttttatacaaagtaagagaaatgcgaagggtacgagtagaggggttaccaatagcggctacaaatatccggaaggtttccaggttttaggtgaatggaatgagataggatgtcctacttatctttcttctactccaacggaaatagatgggcagctcatgtataatatccgtgaagtttttattaagccgggtggaagtgcagcgatggaagattattatcctgaatatataggtgataatgtaaatatagaaatcaatgttaagaaaccaacagaaataggactggttatgctcagcagtacaggtaccaaacaaaacacagtcggttatttcacctaccctaccgatcagaagccgactgatataagtcaagttacaccgatcattgcctatccgcgcatatcgactgccgtgtgtaattccagcagtacagcaggtagtatgtataccggcgacagagtagaactgaaatattgggatggcacaaagttcgtgaacgagttccctgcgggagtaagcatagcatggtttcttattgagtcttcctacaaccaaggcacaaaggagattatgaataataaacgtactttctattctattcgtgatctgaataagagcaaagaacaccgtaccattgccctaaagaacaaatcaggagaagtcgttgcatttggtatggaggatgcaaccaactttgaaccgacaggagataataccagaaaaggaaactttggcgatgccgtattctatcttgatttctcagatggatcagccattgagactggtggtgtagaagaactcccagacaaatccattgacaacaaagagatttataactcctttaaaggtgtattatcatttgaagatttttggccatccaaaggagattatgacatgaatgatatgattgtcgaatataagcgcgaaatttataagagtgttctcacaagtaaagtcgtaaaagttatagatacatttgtgcctaaacatgatggcgcaaactggcaaaacggttttggttaccagctcacaggtatagcaaatagtgatataaagaaaataaccgtagaatccggcggaatcgtctcacaattcatggaagggcaagaccgggaacctggtcaaaattatcccactattatcctttttgacaatcaaaaagcagctataaacaaaacgtttactgtaacgatagacgtcgcccaagaaagatttacagaaacagcatttactcctttctttaataacaaattttgggaacaaacatacagcaaatttaatatgaacccctttatcatcatttctgccaatacaggacgtgataaagaagcacatattgtgaaattccctccaacaagtaaaatgaatttctcttatttcggcacaggtagtgatgtatccaggcctgatgagggattatattatgtaaataatgagaatatgccaacgggactgcagattagcggtatcagtgtaggaactaaacgtggtaccgatttccttgtaccagtagaaacgacaagcattttggaagcgtatcctaaatttggtgactgggcatccagcttcggcgcttccaatccatattggtggaaagaccctgataattcgaaagtaattacccaataataaaaaagactgtctgaaaagtatgtaatccctatcattaactttacccaaagtctttcttaaagatagagtacaattccttttcggacagtctttttctattcaacaacatcccagtcccgttccggaacacataaatatattttgttcagggcaggtattacattctggaaggtacctcaatgcccaacaagcccattcctaaacgaaccacttttgctacattggcagacagagcaatacggaatacttttaccgcctcattctcttcacgcagaatgctgaaatcatggtagaactgattatattctttcaccagatcataggtataattcgcgataatagacggactgtagtcttctccggcctgttttacaactgccgcaaagtcagcaaccaactgaatcaatccttcttccttctcgctcagttcgataccagcaggaatctgttcaggtatcacaattccagactcagccgctttacgaagcacagactgaatacgggcatacgtatattgaatgaacggtcctgtattaccattgaagtcgatagactctttcggattgaaagtcatattcttacgggcatctactttgagaataaagtacttcaaagcacccagaccgacaatacgggcaatatcatctgcttcttcctgcgtcagaccatccagttttccgagttcctgcgaagtttcttttgcagtcgataccatctcttccatcaggtcatcggcatcaacgactgttccttcacgagatttcatcttaccttccggcaattctaccataccataagagaaatgtacaaggcctttaccccattcaaaaccgagtttatccaacagaatagaaagtacctggaagtgataattctgttcgttaccaacgacataaatcattttatcaatcggataatcagcgaaacgaagtttggccgtgccaatatcctgcgtcatataaacagaggttccatcgccacgaagaagcagcttatgatccagcccctcggcagtcaggtcaacccagacagagccgtcttcttttttgaagaaaaagcctttttccagtccctccattactttctcttttccttcaagataagtattggattcataatatatcttatcgaagccgacccccatcttccggtaagtctcatcaaatccggcatacacccagttgttcatcatctcccacagggcacgtacttccggatcaccggcttcccatttcaccaacatttcgcgggcttcctgcatcaacggagaagcagcttccgcttcctctttcgtcatgcctttttccatcagttcggcaagttccgctttataatgcttgtcgaaagacacatagtagtcgcctaccagatgatcacctttcttgccggtgctttcaggagtttcgccgtttccgtatttcttccatgccagcatggatttgcagatatggataccacggtcgtttactatattcgtctttactactctgtttccgtttgcagccacaatgttagccagcgcatttcccaaaagattgttgcgcacatgacctaagtgaagcggcttgttggtattcggtgaagaatactcaatcatcaccaacggagaagtttcggtagctttcaccaggccgtactcttcatccgactgaatctcattcagcaactcaatccaggtagccgatgcaatagtcagattcaaaaagccttttattacattgaaagcagctacagccggttcgttcgccttcagatattcgccaatttcctgcgctgtctgttccggtccttttcttgacattttcagaaaagggaacacgaccagtgtcaaatgtccttcaaattctttcttcgttttttgcaactgcaccatcttctcagggacttcctgaccgtaaagtgcttttagtccgttgatgacggacgctacaagtttatcttctatcttcataatcaagttgtttcttgcgcgcaaagatacaaaaaaaggagacgcacgcgcctccctcttctaatttctttcaactatatgtttattcaacagctgcagacaattcagcaccagctttaaatttagctactttcttagcaggaatagtaatagctgcctttgtagaaggattaataccggttcttgctgctctttcacttacagagaacgttccaaaaccaaccaaagctaccttatcaccagctttcatagcgttagtaactgaagaaatgaaagcatcaagagctttcttcgcatcggctttactcatttgagcttcagcagccattgcactaataagttcagacttattcatgatacgtaaaatgattaattaatatatatgttacacaaaagatttcccattacgactttacaaatatagatgaacaaaacaacatatcaaataaaaacataaaaaaaacgcagcaaattattgaaaaagagctaatagggaagcttttccatgctttaaaacagaatttattcgtacttttgcgttcattacttaaatattcagaatataaaattatgccaactgtaactaaaaacctgataattatcaatgtactagtctttttcgggacacttgtcgcccaacgatacggtatcgatctgactaattatctgggattgcattttttcctcgccagtgacttcaatccggcacagcttatcacttatatgttcatgcatggcgggttcagccacatttttttcaatatgtttgctgttttcatgtttggaactgttcttgaacggacctggggaccgaaacgtttccttttttattatatcgcctgtggtatcggtgcaggacttatccaggaaggagtgcaatacatcaaatatatagtagactacagccactattcacaagtggatataggaacgggaattattcctatgggagagtttttgaacatgctgaccaccgtgggcgcttcgggagctgtatatgccattttgctcgcattcggtatgttgttccccaacaaccagctattcatctttccgctgcccttccctatcaaagctaaattctttgttatcggttatgctttgattgaactgtatgccggctttgccaataatcccggagataatgtcgcgcatttcgcccacttgggaggtatgatattcggatttatcctgattatgtattggagaaaaaaaagtagaaacaatgggacatattataactgatttaaaagaaacgttcagaagaggaaacactttcatccgactgatttacattaacgtaggcatctttgttatcggtacgttaatcagtgtcatattgcagctgttcaacctgagtgcaacgggaatattcgatttattcgcccttccggcttcccttcaccggtttattcttcagccatggtcattgctcagctacatgttcatgcatgcaggcttcctgcatatcctgttcaatatgctctggctgtactggttcggaagtctgtttctctatttcttttcgggaaagcatttacggggattgtatgtattgggaggcatctgcggaggattgttctacatgatagcgtataacatcttcccttatttcagccagacattgccgttctccacactggtcggggcttccgcttccgtgctggccatcgtagctgccaccgcctacagagaaccgaactaccgggtacaacttttccttttcggcgccgtccgtttgaaatacctcgcactgatcgttatcggaacagacctgctctttattacatccaacaatgccggaggacacatcgcccacttaggcggcgcacttgccggactttggtttgcagccagtctgagcaaaggcaaagacgtgacttactggatcaactggttccttgacggcttcgcttccctgtttcagaaaaagacatggaaacgcaaaccaaaaatgaaagtacattatggaagcgacacaagtcgcgagaaagattacgattataacgcccgtaagaaagcacaatcggatgaagtagaccgcattttggaaaagctgaaaaaatccggttatgaaagcctgacgacggaagagaaaaagagcttgttcgacgcaagcaaaagataaagaatggaacacattggcaaatttgtcctttatttgatattggcagtcaacgcactctttgtagggatgttgattttgagtgcctatagcccgtatcttcaaccgaaaatacacccgatagcttcttgcctggggcttgccttccccatcttccttgctgtcaacatctgtttcaccctattctgggtaatcatcagctaccgctatgccttattaccggtcatcggttttctggtatgtattccacagatacgcacctatattcccatcaattctacagtagaaacgataccggatggcagcatcaaattcctctcttacaatgtgatgggatttaacaatctggagaaaaaggaaggaaagaatccgatattatcctatctggctgacagtgaagctgacataatctgtcttcaggagtacaattcaaccaaaaacaagaaatatctgacagacgaagacatcagaaaagcattgaaagcatatccctaccgttccattcacaatccggaaaaaggaggcagtcagttggcctgtttctccaaattccccatactttcggcacgtcccatcaagtatgaaagcacctacaacggttcgatgcagtacaccctcaaagttaacgaggacactatcaccctcataaacaaccatctggaatccaataaactgacgaaagaagacaaggtgatttatgaagatatgattaaagacccgaacgcaaagaaggtaaaaacgggtctccggcaattaataaagaaactggcggaagcatcggccatccgttcttcgcaagcggattcggtagccgtcgccatcgcaaacagcaaatacccgactattattgcctgtggcgatttcaacgacgcttccatttcatatacccatcgcatcctgactcaacagctggatgacgcctttacacaatccggcaggggactgggcatctcctataatctgaataaattctatttccggatagacaatattctgatcagccccaaccagaaagcctacaactgcaccgtagaccgttcgatcaaagattcggaccattacccgatctggtgctatataggcaagcaataaagcagaaaaacttaaataaataccatgatgattagaaaaactttaaccattttagcagtaagttgtatgatgtactcctgtggaacaaaaacagaaagcaaccctttcttcactgaatttcaaacagagtatggtgttccttccttcgataaaatcaaactggaacattacgaacccgcctttctgaaaggtattgaagagcagaatcagaatatccaagccattatcgcaagcccggaagtgcctactttcgacaatacgattgtagctttggacagcagcgcacccattctggaccgtgtaagcgccattttcttcaatatgacggatgcggaaacaaccgatgaactgaccgagctctctatcaaaatggcaccggtcctttccgagcacgaagataacatctccctgaatcaggagcttttcaaacgtgtaaacgttgtatatcaacagaaagattccatgaatctgaccacggaacagaaacgtctgctggacaaaacttacaaaggatttgtccgttcaggtgctaatctggatgcagagaaacaggcacgtctgcgtgaaatcaacaaagaactttccactctcggcatcacattcagcaataatatactgaatgaaaacaatgctttccagcttttcgtagacaagaaagaagatttagccggattgcccgaatggttctgccaaagcgcagccgaagaagccaaagctgccggacaaccggggaaatggctgttcaccctgcacaacgccagccgccttccgttcctgcaatacgctgagaaccgccctctccgtgagaaaatgtacaaagcatacatcaaccgcggcaataacaatgacaagaatgacaacaaagaaacgatccgcaagatcgtctccctccgcctggaaaaagcaaggctattgggcttcaacaactacgccaacttcgtactggatgagacaatgtcaaagaatgacagcaacgtaatgagtctgctgaacaacctttggagctatgccctcccgaaagcgaaagccgaagccgcagaacttcaacagttaatggacaaagaaggcaaaggagagaaactggaagcctgggactggtggtactacacagaaaaactccgcaaagagaaatacaacctctccgaagaagacaccaaaccttacttcaaactggagaatgtacgtgaaggagctttcgcagtcgccaacaaactatatggtatcactctgaacaaactggaaggtatcccgacttatcatccggatgtagaagtcttcgaagtgaaagacgctgacggctcccaactgggcatattctatgtagactatttcccgcgttcaggaaaaagcggtggcgcatggatgagcaattaccgcgaacagcagggagcaacccgccccttggtatgcaacgtatgcagtttcaccaaaccggtcggcgacaccccttctctgctgactatggacgaagtagaaactctgttccacgaattcgggcacgctctgcatggcttactgacaaagtgcgaatacaaagggacttccggcaccaatgtcgtacgcgattttgttgaacttccttctcagatcaacgaacattgggctaccgaaccggaagtgctgaaaatgtatgccaaacactatcagacaggagaagtaatccccgatgaaatcatcgaaaagattctgaaacagaaaacgttcaaccaaggattcatgaccaccgagttactggctgccgccatcctcgacatgaaccttcacatgataacagatgtaaagaatctggatatgcttgctttcgaaaaagaagccatggacaagctcggcctgatccccgaaattgccccccgctaccgcgtcacttacttcaatcatatcattggcggatacgctgccggatactacagttacctttgggcgaatgtacttgacaatgatgcctttgaagccttcaaagaacatggaatctttgataaaaacactgccgacctcttccgctacaacgtattggaaaagggagacagcgaagatccgatgatactttataagaatttccgcggtgcagaaccaagcctggagccgttactgaaaaacagaggaatgaaataaaacggcaaaaaagcccttaaacatcaaatatttgagggcttattacatatgaatgtgaaaaaaaaactatatttgcagccttgtatgcggcaaaatggacttgtatacgacagaatttaactgaaaattaaattaaaaaagtaatcatcataaattaaaagtaaaatgcaaaacaaaggatttgtaaaggtttttgcggtactactcacgctggtatgcgtgttctacctctccttctccttcgtaacccgccattacactaataaggcgaaagagattgcgaacggcgacccgaaagtagaacaagactaccttgactctctctccaatgagaaagtaatgctgtggaactggacgctgaaagattgtcgtgaaatggagatcagtttaggtttggacctaaaaggtggtatgaatgttatccttgaagtttctgtgcctgatgttatcagagcattggctgacaacaagccggatgaaaacttcaataaagcgctgaatgaagctgcaaaacaagctgtcaacagccaggacgatatcattaccttgttcgtcagagaataccagaagactgctccgggcgcaaaactttccgaacttttcgcaacacaacagttgaaagataaagttaaccagaaatcatcagatgccgaagtagaaaaagtattgagagcagaagtaaaggctgccgttgaaaactcatacaacgtgcttcgtacccgtatcgaccgcttcggtgttgttcagccgaacatccaaagcctcgaagataagatgggccgtatcatggtggaacttccgggtatcaaggagccggaacgtgtgagaaaacttcttcaaggttcggccaacctcgaattctgggaaacatatactgcaaaagagattcttccggctatgcagtcggctgactcaaaattgcgtgctatcctgtcacaggaaactgccgctgattctacagccactaacgcaactgcagacacaatccccgcagccaagctggcagaagctactccggcaaagaaagccgtaagcgttgccgacagtctcgcagctactctgaaaggagatgccaaagacgaaaaggcgggagcaaacatggaagaaatcaaaaagcaatatccgttgctagctgttcttcagttgaattcaagcggtcagggtccggtgatcggctatgctaactataaggatacagccgatatcaacagatatctgagcatgcctgaaatccagtcagaacttccgaaagaccttcgtctgaaatggggtgtttctccttctgaattcgataagaaaggacagacattcgaattgtatgctatcaaatctaccgaacgtaacggcaaagctccgttggaaggtgacgtagtaacagatgcaaaagacgaattcgaccaatacagcaaaccggctgtaagcatgaccatgaactctgacggtgcacgccgctgggcacagttgaccaagcagaacatcggtcgttctatcgctatcgttcttgataactatgtatattctgctccgaacgtaaactctgaaatcacaggcggacgttcacagattacaggtcacttcaccccggaacaggcaaaggacttagctaacgtattgaaatcaggtaagatgccggctccggcccacatcgtacaggaagatatcgtaggtccgtctctgggtcaggaatctattaacgcaggtattttctcattcgttgtagctttgatcctgttgatgatctacatgtgttccatgtatggcttcatcccgggtatggttgccaactgcgcattgttcctgaacttcttcttcacgctgggtatcctttcatccttccaggcggcactgaccatgtccggtattgccggtatggtgttgtcactcggtatggcggtggatgcgaacgtacttatctatgaacgtacaaaagaagagcttcgtgccggcaagggtgtgaagaaagcattggctgacggttattcaaatgccttctctgctattttcgactccaacctgacatctatcatcaccggtatcatcctgttcaacttcggtacaggtcctatccgtggttttgccactacattgattatcggtatccttgtatccttcttcactgctgtgttcatgactcgtctggtttacgaacacttcatgaataaagacaagtggctgaacctgacatttacttccaagatttccagaaacttgctggtaaatacccgtttcgacttcatgggaaccaataagaaatcactgatcatcgtaagcgctattatccttgtttgtatcggttcgtttgcattgcgtggtttaagtcaaagtattgacttcaccggtggacgtaacttcaaggtacaattcgagaatccggtagaaccggaacaagttcgtgaactgatcgctgacaagtttggtgaagatgtaaatgtaaatgtgatcgctatcggtacagacaagaagacagtacgtatcagtaccaactaccgtatcgcagacgaaggtaacaatgtagactctgagatcgaatcatacttatacgaaacactgaagccgttgctgacacagaacatcacactggctactttcatcgaccgtgacaatcacacaggcggtagtatcgttagttcacagaaagtgggtccgagtatcgcagacgatatcaagacaggtgccgtatggtcagttgttctggctctgatcgctatcggtctgtatatcttgatccgtttccgcaacatcgcttacagtatcggttctatcgtagctctgacttgtgatacgatcatgattatcggtgcttactcattgttgtggggtatcgttccgttctcactggaaatcgaccagacattcatcggtgctatcctgacggctatcggttactctattaatgataaggtggtaatcttcgaccgtgtacgtgagttcttcggcttgtatccgaaacgtgacaagcgtcagttgttcaacgactctctgaacactacactggctcgtaccatcaatacttcattgagtacgttgatcgtattgctgtgtatcttcatcctcggtggtgattcaatccgcagcttcgcattcgcaatgatcctcggtgttgttatcggtactttatcttcgttgttcattgcatctccgattgcatacaacatgatgaagaacaaaaaagtagtggtagcagctacggaagaataataaattccagaaatagaaaaagcctcttccgaacattcggaagaggctttttctattgattattaaaacaaatagaagctataagacgttaatcttaaaagaagccattgtaatacttaaaactcaatacagtatgaagcaaaacaacaccgcctcccgcagatttctcttagtagccccgaggggaatcgaacccctatctaaagtttaggaaacttctattctatccgttgaactacaaggccgcttttattttggttgcaaagataacggtttctgttgatttaacaagaataaaaatgcaggttcctttcagtaaatccaattatttggcgtcaataggacaataaagttcgatttattttgataattcgattaactttccgacctttgcgctcacaaattgaaagtaaaatcagtttttaaattaaatatagtaattaaagttatggcagacgaaatgatggttaaagaattggaggaagtcgtagtacgtttctccggcgactccggcgatggtatgcagctggcaggcaacatcttctcgaacgtgtcggctacggtaggaaatgacatctgtacattccccgactatccggcagacatccgtgccccgcaaggttcactgaccggtgtttccggttttcagatccacgtaggcgcaggacaggtgtacactccaggagaccgttgccacgtattagtagcgatgaacccctccgcactgaaaacacaaatcaaattctgtaaaccgcaaggacttatcattaccgactccgactcgttcgaagccagagacctggaaaaagcacaatttaagaccaacaatccttttgaagaattaggcgttaaacaagaagtgctggaagtgcccatctcttctatgtgcaaagaaagtctgaaagattccggactggacaataaaacgattctccgttgcaagaatatgtttgcgctcggactggtttgctggctgttcaaccgcaatctggcagcagcggaaaagatgctgcgcgagaagttcgccaagaaaccggaaatcgcagaagcaaatattaaggtattgaacgatggctacaactacggtgccaacacacacgcttctacctctacttataagattgaaagcaaagctccgaaatcaaaagggctttatacagatattaatggtaacaaggcaacatcttacggattgattgccgcagccgaaaaagccggtttggaactgtatctgggttcgtacccgatcactccggctaccgacattctgcatgaattggccaagcataaatcactgggagtaaaaaccgtacagtgcgaagacgaaatcgccggttgtgcttctgccgttggtgcagcttttgcaggtgcgctggcagtaacgacaacttccggtccgggcatctgcctgaaaagtgaggcgatgaacttggccgttatcggcgaacttccgttggtgattgtcaacgtacagcgtggtggtccgtctacgggtctgcctaccaaatcggaacagaccgacttgctgcaagcactctacggtcgtaacggtgaaagcccaatgccggttatcgccgccacttcaccgaccaactgtttcgatgccgcctacatggcagccaaaattgctttggaacacatgactccggtcgtattgctgacagatgctttcgttgccaacggctctgccgcatggaaacttcccgatctgaatgactaccctgccatcaaccctccgtatgtaactccggacatggcgggcaactggaccccgtaccaacgtaacgaagaaacaggcgcacgctactgggcgactcctggaacagaaggttttatgcaccgcatcggtgggcttgaaaagagtaacgaaaccggagccatctctaccgaacccgaaaaccacaacaagatggttcacctgcgtcaggcaaaagtggacaagattgcagactacatccccgaacttgaagtgctgggcgacgaagacgcagacttactgattgtaggctggggcggtacctacggacatctccgtctggctatggacttcatgcgcgaacatggaaagaaggttgcattcgcacacttccagtacatcaacccgctaccgaagaatacagccgacgtattacgtaaatataagaagatcgtagtagccgaacagaatctgggacaatttgccggttacctgcgtatgaaagtacccggactgaatatcagccagttcaaccaagtgaaaggacagcctttcgttacgagagaattgatagatgcatttactaaattattggaggaataagagatgagcgataaagtatataccgtacaagattataaatcaggtcagcctcgctggtgtccgggatgcggtgaccacgctttcctgaactcactgcacaaggcaatggccgaactgggagtagctccgcacaatatcgccgtaatttccggtatcggttgctcttcccgtctgccttattatgtaaatacgtatggcttccataccatccacggacgtgccgctgccgttgcaacgggtgctaaagtggctaatccggatttgactatctggcagatttccggtgacggtgacggtctggctatcggtggtaaccacttcatccacgctgttcgtcgtaacatcgacctgaacatgattctgttgaacaaccgtatctatggactgaccaaaggacagtattcaccgacttccgaacgcggattcgtcagcaaatcatctccttacggaacggtagaagaccctttccatccggcagaactggcattcggtgcacgcggacgtttctttgcacgttgtatcgctgtagacggcgccgcttctgtagaggttctgaaagcagcagccaaccataagggtgcatctgttgtggaagttctgcaaaactgtgtaatctttaatgacggaactcacgcttctgttgcaacgaaggaaggacgcgcaaagaatgcgatctatctggagcacggcaaaccgatgttgttcggtgaaaacaaagagttcggactgatgcaggaaggtttcggactgaaagtggtaaaacttggcgagaatggcatcacagaaaaagatattctgattcacgatgctcattgccaggacaatactcttcagttgaagctggctttgatggaaggccccgatttcccgattgcactcggtgtgattcgtgaagtagaggcacctacctacaatgacgctgtagcagaacagattgaagaagtcaaaggcaagaagaaatatcataatttccaggagttgctgatgacgaacgatacttgggaagtgaagtaattcattttactgagaaaaaatagaaaagcgcaggtaaaggagttcgtctcctgcctgcgctttttgtttatatagtttctacataaatacatgaaacactctgttccattttagcaaactcctctacaaagcacctacacttctgtattcaaaggttatagcctttttcttcttcagccaattacagaagccgcttgcttaagtaacgcactggataccatactgacaggaatcccactgctaaaacagtaataaaaataagcactacatcccatgcatggacacttaccggataagcgtccaccacaaaagttccaccacctccgccaagggtaatgatgccaaacttctgctgaataaaacataatatcaaccccagtataataccggagatagcaccaaagagagagatgagccgtccctcaaataaaaagatacgggatatcagtttatcactggctcccaaactgcgcaaggttatgacatcgtctttcttatccagaatcaacatagaaagagaaccgatcacattaaaacaggcaatcatcagaataaaagtaagaaacagataagagatcagcttctctatttccatgatacggaaaacatctgcttgctgctgataacggttctgtaccacaaagtcatcacccagcattttttctattttagactgtacggatgatatattggtattcggtttcagtttcaactcaatgccagaaacctctgtcgtatagtccaataagttacgaaggaaatcaagggaagtgagaatatagctttcatcatacttctgttggttgaccacgaacacaacacccggtgaataaagatagtcgcgattgaaagaagccccgggattcgccatattcactttggcattacgcttgggaagatacacctgcaaaggatctacgaacgccagtccggtacccaaagtcgaaaccagttccacgcccatcaccccataattcactatcgaatcatgaagaataaactcgccggctccgtaaagaatgttatctatttcggttaaatcctcaaagttatcttccacgcctttcaacacaaccatagcctgacggtctttatattgcaccatcgcattctcttccagcgtctctgtagataccgagacctccggaagcgcacagaccgcacgaatcctttcatcctgtccgtcgaagacttttccctcgcggatggtaatcttcaactgaggatcaaaagctgtgaaaaagctggctaccatatcctgaaatccgttgaatacggaaagcgtgcagaccagtgccaacgtagcaagtgccaccccgcatactgatatgccggaaataatattgatagcattatgcttctttttcgagaaaagataacgccgagctatgtagaagggaaaattcacttcagcaaagaatcaatcttctcaatataatccagtgagtcgtccacgaagaacttcaattcgggaataatccgtaattgatgacgcacacgggttccgagctcaaagcgaatggacttcatgttctcattgatattcttcaccatttcttctgctttctctgacgggaaaacgctcaggtacacgcgcgcaatactcatatcaggactgatacgaactgcgctgaccgatattaatatacccggcattgcctttgtctgaagcaggaatatctcgctcagctccttctgtaacaggcgggatatcttattctgtctggttgtttccataaatttactccttatcttacttttttcttattatagttaacccatcacgcaaaggcaggattactttctccacccggtcgtccgtcacaagggcgtcattgaatgctttgatgccaatggtctgcgtatccgcactacgaggttgttccaacacatgaccatcccacaatgtattgtcggcaatgatatacccacctgtggaaagatgctttaaaaccatctcgtaataatcgatatatttacgtttatcaccgtcaatgaaggccagatcgaacgtaacgcccaaatgaggaacaagctccaaggcatctcctatataaaagcgaatcttgtccgcaaaaggagaattctccagccagggacgggtaaagtcctcttgttcatcattaatttcaaacgtatgcaacattccgccctccgacaagccttccgccagacaaagggcagaataaccgctatatgttccgatctccagtatatgccgggggcgaatcatctccacaaacattttcagcatccgcccctgtaaatgcccggaagccatacggggacgaagcagtttcacatgcgtatcccggtagagtgctttcagatagtcactttccgcatcgatatgctgcaaaatatattcatcaatagattcagtctcctgcataaaaaccttattttagatgtaacagttagagataacgattgttgttaggcaatacagtttctcccgcatgtttcaacgcatcttccacgacattgatttcgaggaatgaagtttgtgtacctgccttaccgctactcagatatcctaccatatcagtcggctgcaaacgtccttccttcaacaggcggcgcaaagcggcaaaataatattcctgtccgttggccagctccggcatatagattgcttccactccataagaaagtgccagatgacgcatggtcttttctttatagcagatagccaataccgggaacttaccacggaaagctgccagattacgggcggtccgtccgctatagctgtctgtgatgatggcacgtatcttcagtttcgatgtagctttcactgcctgtttagcaaggaaggccgttacatcgttactgttttcgttcaacgggatacggatatcattctcttccagtttatctttttcagcctgggccgcgatcttggtcattgtcttgactgcatctaccggatatttgccataagcagtctcaccgctcaacatcagagcatccgtacgatagtagattgcattcgcgatatcggtcacttccgcgcgggtcggacgaggattgttgatcatggtatgaagcatctgagtcgcaacgatcaccggtttctttgccaggatacatttgcggatcagcacacgctggatacccggaatacgttcctgcggcacttcgatacccaggtcaccacgggctaccatcacgccgtccgccacttcaagaatctcgtcaatgttgtccaccccttcctgattctcaatcttggcaataatccggatatcactattgtgagcatccagaatttcacggatatcaagtacgtcctgacggttgcgcacgaaagagtgagcgatgaaatcgatatccttttcaatcgcgtaaagtatattgttacggtctttctctgtcaatgaaggaagattgatacgaacacccgggacgttcacgctcttgcggcttcccaacgttgcatcgtttttcacttcgcaaagcagataatcggctgtcttatcgattacttccagttcaagatcaccatcgtcaatcagaaccagacctccgatattcaaatcgttcacaaagttaggatacgaaacagcgatacattcacgagtcgtctcctgatcaggattgccgacaatctttactttatcacctatctgatatggaatcggttccgcattggcagttgtacgtacttccggtcctttggtatccatgaggattgcaatccggttggatacggaacgtacattggcaatcaacgcttcaaaaccttcacggctagcgtgagccgtattcatacgtaccacattcatcccagcttcaaacagctgttttataaagtccacatcgcaacgtctgtccgaaatggatgcgacgatttttgtctgtttcagtaacatagcctttttacctatttaatatattaataccttatttattacctaacaaagcctccagagccaaccgatacgagttcagcccgaagccacagatcactcctttgcatgcgcaggcgatcatagatacatgccggaaagactcacggctatgtacattagaaatatgtacctcgatcaccggagaagtcacagaacgaatggcatcctgcagagcgatggaggtatgtgtataagcgccggcattcagaatgataccgtctacctcaaaacctacctgctgaatgcagtcaatcatttctccctcaatgttcgattgaaaatagtcgatctccaaatcagcatatcttttacgaagctcagccagatagtcttcaaatgtaacacttccgtatatggaaggttcacgtttgcccaacagattgatgttcgggccattaataatttgtattctcatcgccgtagtcctgcttttttaatacctttgtatccaaagaacaatatttcaggctacaaaggtagaaaaaagaaatggaaatcaacgaaaaaaacaagaagaaggagcaacaagcactgataatcagaaagtaccagcagtacctcaagctggaaaagtctttatcccccaatacattggacgcttatctgaccgatctggataaactgatgagttttctgactctggaagggatagatgttcttgaagtatgcctgtccgatctccagcgtttcgctgcgggattgcatgacatcggcattcatcctcgttctcaggcacgcattttatccggcatcaagtccttcttccgtttcctgattatggcggattatctggaggctgatcccagcgaactgctggaaggtcccaagataggattaaaactccccgaagtgctgaccgtagaagagatcgacaacatcatctcctccgtagaccgcagcaaagccgaaggacagcgcaacagagctattctggaaacattatacagctgcggactccgtgtatccgaacttgtcagcctcaaattatccgatctctattttgatgaaggcttcatcaaagtagaaggcaaaggaagcaagcaacgtcttgttcccatttccccccgtgccattaacgagatcaaactttatttcttggaccgcaaccggatagaagttaaaaaagactatgaagattttgtgtttgtcagccagcggagaggcaaatcactttcccggattatgatctttcatatgataaaagaattagcacaaaatgcgggtatcaccaaaaacatcagtccgcacactttccgacactcctttgccactcatttactggaaggtggcgccaatttacgggccatccagtgcatgctcggccacgaatcgattgcgacgaccgaaatttatacccatatcgaccgaaacatgcttcgcagcgagattatcgagcatcatccccgaaatatcaagtatcggcgagaaaaagagtcgggttttcattaaattatgataaaaacctcctgctaactacataattatattaagaattaatatctttgcgatgtttttcctttattaggattgaaaaggggttataaatatgacgatatttcaattacaaacatttaatttatacctaaaatgacaaagaagttgtacttgcctttactcatggcaattgttgttgcacttttctcttcgtgcaagaaaatgggtcccctgtcagcggactacttcactgttactccacaagtgttggaagcagtaggtggtaaagttcctgctaccattaatggtaaattccctgaaaagtatttcaagaaaaaagctgtagtagaagttactccggttttgaaatggaatggcggtgaagctaaaggacaaagtgctgtgttccaaggagaaaaagtagaaggaaacgatcagactatctcttacaaagtaggtggtagctatacgatgaaaacatctttcgactatgttcctgaaatggcaaaatctgaactgtggcttgaattcaaagctaaagttggtaaaaaggaagtcgttatccccgctgtgaaagtagctgatggtgtaatctctacttctgaattggtaaataacacattgggcagcgctaacccggctctgggcgaagatgctttccaacgtatcatcaaggaaaaacacgatgctaacatcatgttcttgatccaacaggctaacatccgttcaagcgagttgaaaactgctaaagaattcaacaaggaagttgctaacataaacgaagctgccaacaagaagatcagcaacatcgaagtttctgcttatgcttctcctgatggtggtgtaagcctgaatacaactctagcagaaaaccgcgaaagcaacactaccaagatgctgaacaaagacttgaagaaagctaagatcgacgctccggttgacgctaaatatactgcacaggactgggaaggtttccaggaactggtttctaaatctaacatccaggataaagaactgatccttcgcgtattgtctatgtatcaggatcctgcacagagagaacaagaaatcaagaacatctcttctgtatacaagaacctggctgacgatatccttcctcaactgcgtcgttctcgtttgactttgaactacgagatcatcggtaagtctgacgaagaaatcactaagcttgcttcttctaatccttctgaactgaacatcgaagaattgctgtatgctgctacactgactaacgatcctgcaaaacaggaagctatctatactcaggcaacaaaacagttccctaacgattaccgcgcatacaacaaccttggtaagcttgcttatcaagctggtaacgttgacaaagctgaatcttacctgaagaaagctgccagcgtaaacgctgctcctgaagtaaacatgaacttaggtttgatctctttgatcaagggtgacaaagctgctgctgaagcttacttcggtaaagctgcaggtacaaaagaacttggcgaatctatgggtaacctgtacatcgctcaaggccagtacgaaagagcagttaactcattcggtgacgctaagactaacagtgctgctttggctcagatccttgctaaggactacaacaaagctaaaaacacactggcaggcgtagaaaaaccagatgcttacacagactacctgatggcagttctaggtgctagaactaacaattcttctatggtaaccagcagcttgaagagcgctgttgctaaagaacctgcgttggctaagaaagctgcaacagacttggaattctctaagttcttcacaaatgcagacttcatgagcatcatcaaataagagaattaccactctattttagatattgagaattgctcgtcattacaaatgacgggcaattcttttttttatctgtaaaaaaccgtactttcgcagaaaagaaatcaaagcaatgaaaaagagtagtattttaatcctcatcattatctgtctggtcggatgcaagaagggctccaatgagacaaccatcaccggagagatcaaaggactcggaacagatacactttatttgtacggcatggacgaactgtacgaccggatagacaccatttatgtagaaaacgataagttctcctacactaccagcgtagatacgatcacttctgcctatctgttactcaagaaccggattgaatatcctgtctttcttgataagggtaacaagatcaaaataaaaggagatacgatcaatctgaatttcctgactatcagtggaaatatatacaatgaggagtttacagacttccaaaaagcactggaagatccggctgatccttcagaaaaagccggcgaagaaacagtggataaaagaataactgtagagaaagcaaacactgccgaagaaatggcggaagagttcatactgcaacatcactcctcctatgtaagcctttacttattagacaaatacttcgttcagaaagaaacgcctgacttcagtaaaattaaaaagctagttgaagtaatgacaggtgtattacaggacaaaccgtatatcgaacgtttgaatgaaacaatcactcaggcagaaaaatcggagattggcaaatatgcacctttcttcagcctgcccaatgcgaaaggagaaaagattacccgttcatcagacgccttcaagcagaaaagcctgctgatcaacttttgggcttcctggaacgacagcatctctcagaagcagagcaacagcgagctaagagaaatctacaaaaagtataagaagaacaaatatataggaatgctcggcatctcactggatgtagacaagcagcaatggaaagacgccatcaaacgcgatacgctggactgggaacaggtatgcgatttcggcggactcaattctgaagtagccaagcaatattctatctataaaatacctgccaacatacttctctcgtcggacggaaagattttagctaagaaccttcggggagaagagctgaaaaagaaaatagaaaacatcgttgaggaagcgacagaaaaagaaaagaaaaacaaacagaagaaataaacggtaatcaaacgtgctaattaaagttttcggagcggctgttcaagggattgatgcaacactcatcacaatcgaagtcaacagctcacgtggctgtatgttctatctcgtcggtcttccggattccgcagtgaaggaaagtcaccaacgtattatctccgcactgcaagtcaatggctataaaatgccgaccagtaacctggttgtaaatatggcaccggccgatatccgcaaagaaggctcggcttatgatttgcctcttgccatcggcttgctgggtgccagcgaaaccatatcttccgaaaagttatcccgctatctgatgatgggagaacttagtcttgacgggagcattcagcctatcaaaggagcactgcctattgctatcaaagcccgtgaagaaaactttgagggactcattattcctcaacagaatgcgcgggaagcagcagttgtcaatcaactgaaggtatatggcgtcagtaatatcaaagaagttatccagttcttcaatggtgagcgggagctggaacagaccgttgtcaacacgcgggaagagttttatcaacagcaaacagcctttgacctggactttgcagacgtaaaaggacaggagaatgtgaaaagggcgttggaagttgctgccgccggaggacataatctcatcatgatcggcgctcccggcagtggtaaatcaatgatggctaaacggttaccttccatccttcctcccctctccctgggtgaaagcctggaaacgaccaaaatacattccgttgcaggaaaactaaaccggggctcttcactgatttcccaacggccattccgtgatccccatcatacgatatcgcaagttgcaatggtgggaggcggaagttttccccaaccgggagaaataagcctggcgcataacggagttttatttttggacgaattacccgaattcaacagaggggtattagaagtcctgcgccagccactggaagaccggcagattaccatctcccgcataaagagcacaatcagttatcccgccaatctgatgctcattgcatccatgaatccatgcccttgcggatactataatcatccgaccaaggcatgtgtatgcagtcctggtcaggtacaaaagtatctgaacaagatatccggtccgttgctggaccgtattgatattcagatagagattgttcctgttccgttcgacaagatatccgatcagcgacagggagaagcaagcagtgttattcggaacagagtcattcaggcacgccgtatacaggaacagcgctatgccgatcatcccggtatctactgcaatgcacagatgagcagcaagttattatccatttatgctcggccggatgacaaaggactttccctgctgcgaaatgcaatggaacgcctcaatctttccgcacgcgcatacgaccgtatattaaaggtggcacgtaccattgccgaccttgagggtgcggaactgatacagccctcccatttggctgaagccatcagttatcgcaatctggacagagaaaactgggcgggataaaagcgcttgacagtaaatcaataaaataccataaagaaaaagtcttcgtctcatataaaatactattttcgcaagatagaatctagtatatgaataaacacgacaacccatattaccccctatttctactcatcggatggcttatcatgctgagtagttgtcaacctgccccatctcatcttctggaaaaagcgatgcagatggagaatgtatcaaccgacagtatctttttctacctgcaacaaatagaagaacccgacaaattacctctcaatgatcaaggagattattacctgttgctctacaaggcaactctgtggaaaacaggaacacctgatgattcattattgcagatcgccatccggcaatataaacaaaacgagcagcaaacccagtatgtacgggcacgcattgagcaaagcgcctcctatttatatcgtaatctgcccgattccacattactgatgagcgaacaaatcctgaaaggataccagctaaatgatacgctaaaaacaaggctgtacgggctacgaagggcagcatacagcagaaagcaggattatccgcaggcattggtgatggcagacagcagcagacaactggctcttaagatgaaagatacacttttctatttttctaccagccagctatatctgcaaattataaacaaaatgcaagatcatgacagatacacccaaagctatctgcagctaatgaaagaacttatggattcgcccaaataccagtctttgaattattatgcgctggaaagtctgttgaacaccagtctgcaaagaaaggatttccggcaagcagtcatatatcttcaacaattatcgagccaacgccgcggaagaaatgaagtaccacactatctgctgctatgcggaagaacccatgccgccttgaatcagattgactccgcccaatattactatcggcaagccgcaatctcatcttccagctttattgccatggaagccaatgcacgcttattcaatctgatcaatgaaaaagaatatccggaacaagtcttttataccaagcagaaggaaagcacgataagggacaatatactaaacaatatcagtacagggatacgggaaagagaattcaaccaactcaaattacagaatgaattataccagctgcatctgcaacagcagcaaagggaactatggatgctgggaatcgttacagctctgctgagtatcggattcatcgcatttttcttttatcagagagagaaaaagaagcgactgctgcgggaaaaccagttactgtacaaagaagccgaagtaagtggactacgggagaaagaaatccggctaaggaataaagaggctgaactccgtgaagcgcttttccggagaatgccattcttccataagctgccctcactccatgccaacaacaatcaggacgaaccgggcaccagtcacaagatagtagtgacagatgcagaatgggcagaagtcacttcagtagtgaacgatgcgttcgacaattttgtcgtccggttacgacaggcttatccacagttgggagataaagaaatcggcttctgctgcctcgtcaaaatcaatgtcaacatacaggatttatctgatatctattgtgtgagcaaagctgccattaccaaacggaaatatcggataaagactgataagctgggaattactgatgagaatataagtttagacagttttctcaaagttttttagctgtcgccccagggtagttgaagtctttgtccgcctgaaaacaaacgcatatatacattatattattaataatcaataacatacatctagtcacatcgtacctttttgtccgcctgtttttttgtttttctactcacttcggtctacttttgcctcagtgataatcagaaaaacagtactaaccaaatacagaaccgtatgaagaacagaattattattttaagtttatgtgctagttgtctacttgcaattgttgcttttgtatacaacagtgaaacaaagaccgacccactggcactctcccctattgtagcaaaacgagtcacgacacctaccggcacactagtctcatgtaatttaaaggctttgaaagacacagtagacattccactcagctatttgacagaagaacttcaagttgtcaaactagacaaccgggacgaagcactagtaggaggctggatacgcaccacagtgggagaaaaatacatcctggtgagcaataacaaacagactccctacaaactttttacccgcgacggcaaattcatcaccactatcggtgcctacggacaagggcccaacgaatatggaaacacatacgccgaccagttggacgaagcccacaaccgtatctacatactgccctggcagagtgacaagctgctcgtattcgatttacaaggcaatcctcagcctcccattcctttatgtatgcgcgtgcccaaaggcaaattcagagtagatacggaaaagtcggaagtcactctgacaactctgcctttcgaaggctggccggctgtcgtgtggacacaagatttcaaaggtaaacgcaagaactttatcgcaccgggacatctgaccgttccgcgcgactttagcaacgaagtatttatggataataatactaatgattacggcgttatgttaatggtgatcatgcctgccccacgaacggacagtctgtaccactataacgcagcccaaaatcgactcgaagccagattcaccgtggaatatccgaacaaggagaaaatcccctggcacggctattccgaatacccacgtcactttattggagacgtttccgtgccgatacaagtatcagaaaacacttggagcggcagcaaacctgccaagtatatcatagataagaaaacactgcatggcagctacttccgcctgtacaatgatttcctgggaacgaaaaagatgcagatatggccctcattcggcaatggttattatgttgccaacatggaacctgcccagctaaaagaaacactggaaaaagaaatagcccgaaaagatattccggcggaggcaaagaaacgtgcacaaacattgataaattcactggatgaagaaggcaacaacgtcattctactcgctaaaatgaagaaataactatcagaaagccagagggtgtttcaaaagtcagtagtaactaaaatggggttgtctaaaatttactatgaatgaaagaattgcgtattcacctaccacctccccctgcgggtactcctccttcctgaaggaggagatttaagatactaccgattttaacacaccttccggcattccgttgagagagcacatccccatttcctttcgatagaaaaacacagacacaattcttataattgtccatctttaaactgattttctctattttctgattctttgattttgccttcctttgcaaagcaaaagattcatataaaataagcagatcatgcagtttacgattacacattggggatgtactccgtcgggagattccatctatctgttccggttgaccaatgctaccggagcctccatcgagcttacaaacctgggagccacctgggtttcggccaatatgccgaaccgatacgacgtctttgaaaacattctgctgggatatgaccatgcagaaggatatctcaaagacacctattatatgggagccactgtcggccggtttgccaaccgcattcatcaggcatccttttctatcgaaggcactacctatctgctggagaaaaacgacggagagaacaccaatcacggcggactatccggctttcacaagaagatatggcaatggaaacggacagattccggcatccgtttccttctccactctccggacatgaaaggaggatatccgggaaatgtacaggcggaagtggaatatcaattcacggaaaccaacgaactgacaatcagctatcacggaaccacagaccgccctacttatctgaatctcaccaatcatgcttacttcaacctgtccggcgacaaacgaaaaataacggagcatgagctcatgatacctgctgcacgaatattagagacaacctcacaatttattcctaccggacaagcacaggatgtcaaagacagtccgtttgatttcagcaccagtcgcagcatcggagcacatctttacaacgataacgagcagttgcactggaacaagggatacaatcattgctatatcctgaaagaagagtcgtccgacacgttattgacagccgccgtattatccgaccctttctccggcagaaggctgactgtcaggactgacttacccggtgtcttattatataccgccggctatctcgctcccacaccggatatcggtgtatgtctggagacacaatactttccggataccccttcgcatccgcattttccgtcctgcctgctcatgccgggggaagaatatcgccacagaactatttatacattcgacaaatgattttttaagtattctacatattgttcccgcttagcttcgtataaacagcgatattttttttactggctatatcttttttattcatatatttgttttacatttgtagtaaataataaaagcaatagtatgaaaacgtccattgtaactcttttaatcacattttgtttttatctgtcagtttatgcacaagcacctcaggataaagccacagaactaaaagaacaggctttaagcagcctgaagcagaaagattacatcaaagcccgttatctgtttaagaaagcgtatgaagcatttgccgtgcgagagaactatccacaagctatagaatgtggtattcaagccaatgctctatatgtcagagaaaacttctacaaagaaggtttcgaattatgccgtaatatggaacaactcatctggacaggcgaacagaagcaaaacaaagtcttttatgacttacgctttcccatcagcaaggaacggttgcagatgtacatttcactgaagaatcccgcacaggcgaagaaccagctggacaaattggaagagattgccagtctcgccaaaaatgattctttaatggaagtgctgctctatacgaaagccaactattactatactttcaatcagaatacacaaggagacgcctgtttccgcaaactcatcagccaatacaaggaaaagaaggactacgataaagtgagcgactgctacaagactcttatcggcatcgcccgcaaagccaacaatgccccgttgatggaacgtacgtacgaaagctatattgtatggaccgactctgtaaaagccctgactgcccaggatgagctgaatgtcctgaaacgaaaatatgacgaaagcctccagaccatacaggacaaagacagcacagtatccgccaagcaatacatcatcataggactttgtacacttgtagctatccttgtagccgcaatcattgtacttgccatcttactgctgaaatttatcaccggcaaccgcaaactcaaaaagagcgtggtcatagccaatgagcacaacgagctgaaaacaaagttcatccggaatatatcctcacaaatggagccgactctgaacactttagggacttccgccaaagagctttccgcccaagcaccaaggtatgcagagcagatgcaggcacaagtagcagccttaaagcaattcagcgacaatattcaagagctttcctctttggagaactcactgaccgaaccttatgaaatgggagaagtcaatgcgggtactttctgcgaaagcgtcatggagaaggctaaagaatttatgaagccggacgtcaccccttctgtaaacgcccccaaactccaagtaaaaacgaataaagaacagctggaacgtatcctgctctacttgctgaaaaatgccgctttctatacggagcaaggacgtatcagcctcgacttcaagaaacgtggcgcgcacacccatcagttcatcataaccgatacgggaacaggtatcccggcagaacaacaggaaaatctcttcaaacctttcacccaggtcaaagacctgactacaggtgatggcttgggattacctatctgctcactcatcgccaccaaaatgaatggcagtctgacattggacacaagctacaccaagggatgccggtttatactggaacttcacgcataagtaacgtaaggtattcaagagctttgtatagttagattacccgcaaccattgtcaactataattatcgtaattagctataatcggagaacgcacattctaactatacaaaaatagcaacagagtactgcataaacggcaaccgggtttataataaatactgtgatcgtttattataaacgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcataaacggcaaccgggtttataataaatactgtgatcgtttattataaacgtccccctcgtttattataaactttaaaatagaaatttgtagaatcaggattgaatttataatacaaaaaaggctgcaaacctcacaaagtttgcagccttttcctatatcgaagcatcctatcctcggctatacgtcagagagataagtactatttgttactatattataccaccgcagccgatgattccacactaattttctcattttatttatcgttcttatattattcagttcaggtttggaactacaaatatacaacaataaaaggcgtttgtcaagtgattaacggatttccatcggtcctgtcattcagcaactacttctataactctgctgttcagacgctgacctgtaaatatattcagtcctaccgtcatcagatattcaccagagaataactcaccgtttccttgcagagaagagttagtacccggcatcagattgatttccttcacccggtactgccgaccggcgtccagtccttgcagacggacaggcaacagtttctcgccataacgggaataaatatcgaatgcaaagacaacagctcccttcttatctttccccacatattgtgtggaagtatgatttccgctataaggagataccagccgatacatgtctccttcgagcactaccggtttaagatgattgtagttggtgaccgcatcacggcagaacttcttctcattatcattgaggtccgacaatttgatatcaaaaccaagtttgcccatcattgctacgtctgtacggaatttgatacttgcatcatgattccatgtagtgacatgtgcacaaagagtttttgccgggaaaagctgagagtatccccattggataaacagacgttcgatagggtccgtgttatcactcggccagaactcagtgaagtatctgagcgcttcatagtcgatacgcccgctaccgcccgaacaaagcatcatcggcagatcagggtacttcgttttaatacgttccagtacattatacagaccgcgaacatagtcgatgtacaagtgcgactgcttctccttcagataagaagagtagatattagtgatcgggctattgcaatcccatttgaagaaagcaataccgggatatttagtcatcaaatcatctactactccaaatacgaagtcctgcactttcggattgctcaggtcaagtaccaactgattacggaagtaatattcatcccgattgggaagatggatgacccagtctttatgtttctcataaagctcactcttcggattcaccatttccggttctatccacagaccgaacttgatacccttctttgtagcttcttcgaccagacgcccgataccgttgggcagtttatctgccgtttcatcccagtctcccaagccttgatgatcgctgctgcgcggatatttattggcaaaccagccgtcgtccagcaagaacatatccactccgagccctgcggcatcgccaatcagtcctatcagtttctcctcattaaaatcgaaataagtcgcttcccagttatttaacagggtcatacgggtttcatctccgtccttcaactgataacggcgtgcccaatcgtggaaattacggctggctttgcccttaccatttgcactataggtaaaatagaaatcgggggtacggaacacgacacctgccggaagataatattcagaggcataagggttgatacccgaaatgatacgcaattcattcttgttgtccacttcgaaagtaaagcggaaattgccggtccatcccaatgtacctaccagcacttcaccacaattctccgtagccagctggtccaaagaaagctggaagaacggaggggtaaacatgttggcacgggcgcccagtttggtatcgagcacttttttaccaaactccaacggctggtcggagatattagcttcgtgagcccagtcgcccgaaaattcagtcagataatacttcgcacggttcagatgaagcatactagaggcatattggtgaagcactacgggcttcttctctttatggctgatttccgtataggttttaatgatatcctcggcaggataagtgacgtaatgcagctttaccgtaaccggatatttatcatctcccagggtgataatggtttcgttaactccttgcgacaccgctttcgtctcatgagagacatacttcaacagaagtgacggattaccgtcattgtgaaggatatgaatggcaggttcaaagtaatcctccataccgtgggtgatataggcttccgtcccttgcggaagatgagaaatatcggcctcatggttcagctttttgcccagatagctttggtataaccgcccgttgtcggctacgcggaagatcagactactgttatccgtatgaatctgaatgacaggcttgtccgccgcgttcagaagacaggtgatactaaggaaacagattaaaaaaaggattctcactttcatgatatacatttaataaggtttataaatcaagtcgttaaaattgtggatggctgaatcaattaaagttgtgaacgaactaaatcagttaaagtcgtaagtgaaccagttgaagaaagcatttcctccgtcacgaagcgtgttgtatgagtacagaccgacacgggcacctttccagtcaccgaatctcagcgaataagcttctccacaaggagtaaagttcttattgtccgtgctatagtacaactgatgctggttggtacgtgcattcatcgttgctctgaaataaatcttcttaccgcttaccggctttactttctccacactaccattattctccagatacagatagttcttgccattctctttgagtattccaatgccattgaacaaattgcctatacagaatagtccggcacgttgtccctcggtccaagaactcatatccatttctgtcgtaaccgtcccctcgtatccgatacacttctgtgtcagcatattgcgtgatgcccgaagatgatccgctttcagagctttcaacagtaaccatccttttcgttccgtcagattccagtcggcgtcagaaggattatgattgaactgccactgcaagttcagctcgggcgaatcaaaggaatcgcctccctgcgggaagcttacaggcactttctttccggtattcggttttgtccagacttttaccggttcgcctatgccgttcatatcgatgtccaccccaatcacgggccatccgtctttccaatgtgcaggttgcagatgcacgactcttcccagcggttccgtcaactggaagtgatagaaccaccactcaccttcgggagtatctaccagtgcaccttgatgaggtccgttgacattggtagaacctttttccagtaccactttcttctcgtaaggaccgtagatgtttttcgaacgcagaattgtctgccatccctcacctactccgccttcgggaatactgatatagtaatatccgtcccgcttgtgaaacttggtaccttctgccaccggaccggtatagatcacgtgtccgtcatcttccaaggtcctcccgtcggcgctcatcttatgcaagatgataggtccggctcccaactggctccgtcccagataagcctgaccattgtcatcccatatcgggcaagggtcttcccatccgccaatccgtttcacacaatgcaaaggtgaccaagggccgtgaggatcggtagccgtactcatcatcagcccttcacggggagtacagaagtaaatccagaacttcccgtcatgatgacggatagagggggcccatgagcctcctccataatttccgttcgtatcccagtccggaaagtccaggcgtcggtacacctgactgataatcttccagttaatcatatcatcggattccagcaccggcatgcccatataatgaaagtccgagtttaccatataatacttatcgcctaccctgatgacatccggatcggaatagtccgcattcaatatcggattgatatacgtgccgtttccctgatctccccatgtcacattctttgtttgtgcacccgctatctgacaagtcagaagcgctatccatacgcaaaggattcttgtattcataatcattgttttaagtatatactcaagcttcatcttctacatgccgaacgaaagaccagaaacaacatgcctatactgatcagccagccaaccagtatcacgatgaaagatttcaccgtaataccgccatagaaatgattaatgaccagctgaatcggcagtataaacaaccctatcgtcagaaacagacctcttcgttttttgtcgttcggtgtcattttcccttcacagttatcaccttcgtgaagtggatattgtcagcggcacttcctatctgaatctcaaactctcccggttccaccacttcctgcatacgggcattccaaagtgccagctccgagatgggaagtttcagtgtgagagtgtttgttgcaccggctttgatcaggtctttcctgaatgctttcagctggcggataggagtagccacggaactgaagcggtcgcgtacatacagttgcactacctctttgccatccatcttgccggtgttcttcacttttaccgttaccgtcagttgatccttgtcggtcaatacagaatcactcaacgcacaatccacatattcaaaagtagtgtaactctgtccgctgccaaagctccataacgggtcgggggcgtcaaagatataatgtcctttcggttcttcgggactgcccggctggtcgaacggttcattacggtctgtgataaaatgattgtagaagcaaggagtattgcctgtgctacgcgggaaagatacattcagtcgtcccgacggattgaccttccctacgaggatatccgccaacgaacgtccctgctgttcgccgccataccattgtaccaacagtgcgtcggcattctcttttacccaaggcatagccaatggtttgccggctatcaatacgacaaccatcggttttccggttttcttgatttcctgcaacagttcttcctgtactccgggaagttccagcgaagagaggtcgaatccttctccggtagtggaatatttcggacttctgcccagataggtactgcgtgttccgacggcaacgattgccagatcactgccgcgaacggcttccaccgcttccgctatcttatcctttttactactccaccagtcacatccttcggcatggcgaaccgttactttatttcctaatacctcctttaatccctgaagcaaagtgacaccttctttggtatctctggtagtccaggcataatctccgtatatcgtctgattgctgttcggacctactacggctattgacttatacttagccaaatccaaaggaagaatctgattcttattttcaagcagaatagcgctctcgtcagctatttccttagccaaagccactttctccgcactgcggacaactttactcactgccttcggatcgccataaggcgcatcaaacagccctaactgaaacttaaccgtcaggatacggcgaacggcaaggtcaatgtattttatatccagacggccttcctgtaccatccgttcgaagttatcataagcagagtcgatgttcaagtctaccccggcttccaatgccaggcgtccggcctcatcggtttcgggcgtgatagcatgaaaggttttaaggcggtccaccgatccccagtcggaataaacataccccttgaaaccgagttcaccacgaagaatatctgtcatgtaataaggagaacctgtgatggctactccatcataagcactataacaagtcatcaatgccaacggattcgtctccttgatgacacgacggaacggatagagatacaagcttctcagttcccgttcaccaccgctgacctgcgcacagttcaatccgccggagggagtgccgtgcgctacaaaatgcttcggcatacaggtgatgcggtttttctgatatccattgataaaggcaatacccatttcggaaataaggtaagggtcttcaccaaaggtctcttctacacgtccccagcgaagttcacgggcaatgtccagtacgggcgagagaatctgatggataccaattactttggcttcctctcccgcagcttcggtcatgcgctggatcagagcaggattgaaggtactcccctgcgccaaagcgtgcggaaacagcgtacaattattttgcaggattccctgaatgccttcgacagaagtaataatggggattccgagccttgttttcgtcagcatgtactgttgcagttctttgtacatggcagcacactcggcggcagtcgtacccatttcgtgggtacagccataactctcaccgttgaatatacggtctatctcgtccagacggcctgcgccccggttctgcaattgcagaaccttttcacgcagtgtcatccgtcccatcaggtcgtctacacgcttctcgatggaaagtgatttattcttataaggtggtacctccgtctttccgacagcctgtcccgaaagggtaagcaggcataaagttacagcacaagttatatttctcagtgtcatagcaagttagttattataaggtgtaaccagtaatttgtaagaaccgcctttcaacaaagacttgtcaaagttaatagtaatctctttattttcacccggcatcagcgtaaaataattatcattcatgatagccggaagaatacgttcaccgtcaactgtgcgtacagcctgtacgtgtacggcaaaagctacactcttggcagacttaggcagtccgattgttgcacggatttccgccttctctcccttctgttccattttggaagaaactttcagttcggccttcggaagttggttcagagcagtgaagtctctgcggtcatttcctctccagtagttattttccgaaatcagtttaccgttcttatccttcagtttcagacggatgaaatgtacatcgctcaaaccttcgctcttaccggttcctcccagcacatcgaagctccacagagaatatccgtaccaccagcctctcttgaacccgaacatacgtacataacgtgcatccttttcggggaaagtaatcagctccacaccaccgattccatttttcgtgctgtaagcctcttcccactgctgggcgtcattcgatacctgaatcttgtattcctttccataagatgcctcccagtcgagacggacaccgccaacgggttgtaccttgcccaaatcaacatatatccactcgttatcacggtaggcacttgaccagcgggtatctttctttccatccacagccattgacgggtcgccttcggaagtagaggaaacaactactttctgattcaatcccaggttcggtctttccttattaaagtcgatggtaaaacactccagcgtactattggacgctgaatgaacaacagaggatttgctataagccggaaccgcttttccgtccatattgtagactgtcacttccgctttcaaatcctgatagttttctgcggtagtattggccaccttcactgcgtccgtcaccggattccagaggatatgcaacggttcgcacgcggacttcgttccccagtaagcgcctgtaagatcataatagtaatcataagtctgccataccatagaggggtaagccgattgtcccatccaggtcatgataccggaagcgtcgtcccacatacggtccagccagccttcatacatagctttgttcgattcgatattgataagctgcgctttacggcaatagtcctcgattccagagggggcgccaaaacctttggcaagagaagcgtcatatctgtccggtgcagcattgaaagcagactgaccgaagtagtgcaaatcccacatcttattacggggccaccaatccttctccggcataaacttcttgaaactttcgaaagtaggaactacagccgtacctatttccgtacggaatccccagccacgctccggatcaccttccagtccgtcaggatattcagtgaaatagaatcgagggtcgaatgctccccaaggaccgctacctgtcaggttgccggcatgtgagttcggttggaaataacgatcgccaccatcaaaggttttgatattctctgccatccagccttccagcgggggctgcgggttcgactcattatcaccacaccatacggccagagacggatgattacggacacgcttgattttctctatcatattgttattgaacgcattcaagtcgtaaggaagattgggattagagttaatccaaaagtcatcccataccatcaaaccatatttatcacacatttcgtaaaactcgtcatcggtagtagagccaagccagttacgaatcatgttgaaattcatttcgtgatggaaacgtagcttggtgtcatactcttcaccacgacatctcagcatgtattccgacattccccagttagctcctttcacaaatacaggtacaccgttgatgtgcagatgcagggtgttgttgtttgtgtcatagctatactccttgataccgaaggtgacgtctttagtttcggagactttcccgtctacggatacttccagtttacaggtatacaggttgggctcaccatatccgttgggccaccacagtttcggcgagttgatcaccagttgcggataataccgtttgtcgaacttcacttccgaagttgcccctggattaatgtctacttctttggtgaacttcacatcaccgggggtgatcgtaccgttcaccacgactttagatggtttgtcagaactgtttttcacttccagcgccaccgacagatcggcgcgtgtgcggctgggtaatggtaagtctgtacgaatccaaggatcgatgatcgttgccgtaccggtgttgctgagataaaccttatccgtgatacccatattcagtcccggcacataaggcatccagtcccagccaccactcgacaagtaagtaggactgccgtagtttgccaacggtgtttgcggcatgtgaactaatactgccagtacgttcggctgatctttcttcactatttccgtgatattgaaacgtcctctgtgcataaatccatcgagtatccccagcaagtgtccgttcagatagatttccgctttacggttcactccgttaaagttgagccatgtcagcgctttatcaaagtcggcaggcactttaaactctgtacgataccagaaactgcggtcatactttgcacggtctacgttgtgaatattatccccaaagttagggtccttttccagtcctgccgttacgtaagaagtaaaagcagtgcccggtacaacagcgtccacccatgatgatgtgtcataacctgcgttcagcagagccggaacatttgttccgacttccgcctccggctttaacttccaggaaacaatcgattcaccactatgcagataaacggggcctgcttgcaaagaagacaccaacaatgaaccaaccattgcaagtccgatacccagcgatttaccttttttcgttataaacttcatacacattattgattatagtattattatttattttcttatcgtaattatgtcgtttgcagcgcatatatatcctggttgttggatctatatgtccaactcgtagcgtatatatgtcctgcgcgttggatctatatgccctgcatgcagggcatatatggtgtatatccactattccaagcacttataagaaccgaattattcggctatatccgctatattcatcagcttgatatagagcactttcatccaagtagacgatccgaaggtgactacccagcctaccgaaacggtagcaggttccgccaaagagaaggtcagggtatgctttccgcccatattggagtcaccgtactggctatatcccaatgcttcttctttcaatcggtcaatgtccggcaatacgctgccgcggctggctgccagatatccgttcattccgttactgcccccttcgagttcacactccaattgataatttccagccggaagttcaaaactttgataaaccttaccattcgtgattccttctccatcccagtctttcgattccagatggatggaataattgccccagtcttcggaccaaccaccttttccattactctgattcaggatattgggagtgaagtcccagtcaacgagtattccccatttattatccgcattcttatcccttccttcaaacggacgtttgtagttcttcagatacaagtcggtaatgtcttcactgactccgtaagagacaactgccgttttaaaggtatcaatcgacatttcatccggcaggaagtaagtctgcacatcaaacttggtcatactcttgtaatccttcaggacggtttcttcttcgctgttttcgatcttcagttcctgtacttttcccgaattatcggtgtaatgcaccatcgtataaagagctgtcggttccgccggcgaccagtcgatcgttacatcatcttctatcttttctaccttcttcaccaagcggttgaccagtccgtctttgtaggagtcaccataggacgttccggtaaggttgaaaggaaccgaaggatgcaatccgtctttatcataggtatgcatttcgaaattataggtcccttcttccagaggaatcggtataatcagcacattatcatttccttctctccggatatcctgttccagagagtcctgtttcaagttccaatatatctttatcttggctattttagggtcggatgccagtactccgcggaagaccacccggttgtaaccggaatacatggcaatagaatcaggaatacccgtataaagaatttcctttccatccgtatatttcagatattcgtccatctttgtgcaagatgtaatccctaacagaatcagtagtgacaccagatagggcgtatgtttgataaattgtttcatattctttctgctttaatcagtcggttaacactcattgaattattcttcgttatcattcccccagaaggtgagttccgtgaaacagatgttgtaattgttagaccaattcttcagacatttgatacggatatagcgtacacgcggcatgtccagaggaacatttgcctgatctcctattttcgcagcttcgatatcatcttccgtcaggataccgataggcgaaccggaaggcttcacattctccatatcgagcagtttcacccactgatcccagctaccgtcggggttaggttccgtagcgcatccccatacttcgtagcgtctcgggctcatgtcgttatagaagtgcttgtcgtcctgaatagcccacaatgcaaaacggctcagtttagccagtacgccaaggtcgaaggtaaatactgccggaccgtctttcgtgcctgttccggtgtgaagtcctacgccaccactgtcaccatctttggagattcttccgttccatacatattccatctttccgtcgtacgaatctacgcgggaatcgttctgcaaatacatttccctgaacttcgtcttatccagttctctttcgtagatcggagtcagctccgtgaacagcgtatctgtctcattcccatatttatcctgcaggaagatgccgaaacgacggggaactgcatcataccctctgacggaataaacgatctcttcacgtgccgagtagaatgtttcggccagcaccatatcgcctaactcatcgggagtacagacgtagatagcaagatcggacttgaacttattgtccatctcgaaggtcatgccgccaaagtcagaaaccaccgatagcgactcgtagcaggacaggataggaggagtcagcggagcgacttccactatctgaggctgagaacggttctcgctacggtctacagtgtacagttctactttataagtatccgtatcgccaaacccctctaccgtaacggagttcgtgtaaaacgaggaacggaactccattacttttcctgttttattagtatacttagccaacacatacagcaaatccggatcggaaggcagtgtataagtgaacttcacagctcccggaaggctttctgtttttacgtcctgaacagtgccaggggcgtctttatcgttttcaatgggctttaccatatcttctgcgcaactactgaaaacgaaaagcaagccgcaagcccatattataaatttacgtgatatcatattctgctgattttaaaatgagacatacattaccatccggggttctgaaccaatttcgggttgactaccaggtcattctgatgaatcggccagaaataatcacgcggagcgataaactttaatgtatacagggttctctgcgaataatactctgcgggagtttcaccctcaaagttccatccgtggatcttctcgttcaataccttattggctgtcttccatcgacggagatcccagaaacggctgccttcgaacatcagttcgatagcacgctcacgctggatgatttcacgaagtccttcctgtgtcttgtatctattgggatacttggagtaagtgtcccatgactccttgattcctttcagaccagcacgtgctctgatctgatccaggtagctgatagccagttcacggttgttggcgtcgtctttctcattcagggcttcggcataaagtaagtataagtcagtaagacgcatttccggccaagggaatctttcggtcgtatagctgctttgggtaacttcataagtggcgctgaccagttttttggtccagtatccagtggttgtatagctgttggttcccagtttcccctgtgcttgtccggcgcggttcttcgctgtccagatgtctttttcactgtctgatggacagttatactgataccaggtgcaaccgtcaaaaccgatattggcatagaagcgaggttctctgtcaaagttcatctgtattgtttcataataagatgccagttcgtatggttgctcgttggtgtgcatctttactttgaaacggtcggcataattccatgttttatcttcgtccattgggacaccgttctttgtgtagtacagattcgtagcttccattgtagggttcagcatttcctgtcctccccacatattgttggggtaagctccgacacgggtcatacaaagactctgcaagtgtgcgtccgaacgtgaagaaagtccccagatcagttctgtattccacttttctgttacgctgttgcgaatgctaagctggcatttggtttcatccgacaggatcaggttgcttttgtaggagtataattctaatcctaattccgggtcctgactggcttcaatggcggcttcgcacgcggcaatggcggcatcccacttagtcggatcttcggtggagttaaacaaatgttctccatccttatccacatagtttgcataatccttattgccattgaacaacggactggcagctgttaccagcagtctggctttcagagtcaggtttgcgatctgcgtcacacgacccaactcactacctttgttggaaatcactctcggaagatcttccagacattcgtccagcaaatctacaatgtactgcactaccttatctaccggctcacgtttctttctcacttcttccggagtagccgaaatcgggagattgtcatcagcaatcacgataggaccgtacattctgaacagacagaaatgataatatgctttcagaaatttcacttcggcaagccatctcttccgcatggaaggagtcaaatctcctactttgctcatgtctgatacgttctccagaaagatgttgcaatcacggatgccacggtaatatacataccacatgttacataaagggtcattgacattctgacgtcccagtgcaatcttccaagggccaaagtcgttgtacggagtaagagggtaataactccagagttcgtccgcacccatcagagcgacattattgtatgggctgtcattgcccggaatgtatgagtaacaagtattcagatacttttccgcctcgttgcggtttgtaaacgagttatcaatcgttcctatcttatcgggcactacatccagatagctgcaggattgtgtcaatgctgttcctccaatcaacagaaggaagtatgtcaggtttctgaccttattcttcatttggtatatcattctatttttcatgctttcctagattttagaagttaatttgtacacccagattgatgactctctgaataggatatcccagtccggaacctcccatttcgatgtcccatagtttaaatccgctaaggaggagcaggttgtttccgctgcaataaacacgtgcggatgatatataggccttcttcgtccagctttccggcagtgtgtagcctacttccagcgttttcaaccgcaggaatgcaccgttacgcataaaccaagagctggttctcacgttattttcaatcactgtcgtactcagacggggccacatagcatacaggttacggttactttccgaccagtggtcgttggcataagctttcaataaaggaatatcctgatgataaggatcgtcatccgtaggattgatgtgctggaacggagaagttgccttcgcatctatccagaaggaagaacgtgccgaaccttggaagaaagccgagatatcaaatcgctgattaccgaatgagaaaccgaatccgtagacaatttcgggtactgtaggatatcccagcggaaccatgtcggcatcggtaatctgtccgtcaccattcacatcccgatatttgatgtcaccggctccatattcgccaaaggtttgtttcggggagttctgcacatcgtattcatcaataaagagacgttcggcgataagaccgtaccattggttcaacgattgaccgatatagcttctgtatttctcgttataggcgggttcttcatatttcagaaattcgctgtgcgcataggtaaagttaccgtgtgcctgcaaccaatacccattgcggaagaacttattataatccactgacaagtctactccgtttgctttcgcttcacccacattggcacgtactttggcagccagacccatatcagccgggatagaagctctgtccatcaaaatgttcgtacgatgctctgtaaagtagtccagctgaatattcaaggcatcaaacaaagtaagctccaaaccgtagtttgcttttttcgcccgttcccaagtgataaggcggttatcgtaacgcttcaccgtcactcccggttttccttcgtcaaagttggttccaaaccaatatcccttacctgaatcattcggatctacctcggagagatagaagaaacggtcattctcgtctccaatcgcatcattacctaccagaccgtaggttgctttcagtttcaatttagggatcaccttgttcatcggacgccagaatttctcattagagattacccaagccaagccggctgcggggaagaatccccaacgttcgtttttatagaagcgctcggaaccgttgtaaccgaagttcagctctgccatataacggctgtcgtaactataagtgaaacgaccggacaaaccctgattacggtaaggcagagacttctgcaaagaaccgctgttcgcattgatcttttcgcgctgctgatataccagcaagccactgacttcgtgaatatcgaaactacgattatactgcatagcagcttctatataggtggtagactgtatatctttccagccttcgctatatcccagatagtctgtcggattggacttctcgttcagcagaccgatattatattgattcgtctttttatcatacgaacttacattataataataaggattgaacgaacggttaacgtcgaaataagagtagcgggaagtattatacaatccacggatgttcagccctttcgtgataaaggataagtcttgctttaactcaaactgtgcatccattgtagaacgggagtagtctttatatccttttgtcagttcggcataaggattggtatagttcgcctccgtctcacggatagcgttaccatacagcaagtgcttcgccgtaggcagtgcatccgacgggtaataggcaggaaacaatacagggttggaacggactatcttcttatacatcacatctcctccgtccagaggtccgcgatagtcgtcaaaagtaccggaaagacgtacgacagcttccgtcgtctttgtcaggttaatattaatgttcgaacgcaactgataagaacgaagattaatgttattatcgaaaccattcatcgaattgctcttcaggtttccgttatctttggaaaaagaagctgcaatatagtatcttgccagcttaccaccaccgctgacattcatgttaacacgctgattggcggtcatatcctttactaaaagttttctccagtcattggcaggatagacatacggattcgtacctttgatcgtgttgtctatcttctcacgcgaatatgccaaaggagccagcgggtttctggttctgaccgcttcattggcaagctgcataaaggtgatcggatcggccagttccacattcttggtattggaagagaatgagttctctacacgaatagacactttagtcgctccttccttaccttccttcgtggctacctgaataacaccattggcaccacgggcaccgtataatgccgtagcagtagcatctttcagaatagagaatgcggcaatatcgtccggttgcagacgtgccagctcggtagtagtcgtttcgataccgtcaatcagaatcaacgggtcttttttgtatccgaaggtcgtgacacctctgataaagaagtctgcgttatcttttcccggctctccactacgctgataggcaatcacaccggacatacgacctgcaagagcagtcgtcaggttactggacggtactttcagctctgcgggcttgatcgtctcgatggagctgatcatactctctttcttttgtgtaccgaaagctaccaccacgacttcatcgagagccttactgtcttcttccagcactacagccaccttattattcttaggaacccttacatattgagtaatatacccgatataagaaatctgaagttctttccctacagggactgaaagagaaaagtttccatcaacatcggtgatagtaccattggaagtacccctcaccactacactcgcaccgataatcggttcttcggaacctgctgccgttacctgtccggtaactgtcttattctgtgccgacagctggcagcagcaaaataaaatcaaagtcaaatagataagcctgattttttccatgtatcagaattttaaattagtattagagttcacatttaaggataaatcaatccgttcaccgaaaggggttatctttccttatccggaacgatggcaaaagtaggagtatatatataggcggtataataaaaatcactgcaaaaaataccatttttgcagcaccagactacatctgaagcatattttccgcagatgtttcatttttgtgcatcatttgttatagtgcacccggacggtcacgaaggcatgtctatcttttctttgtctgcctgactttgtttctcgaaatctttaggtgtcatgccaaactgtttcaggaaaagcttgctgaaataggacggtgagttgatacctaccataaagcagatatctccaatcaggtatttaccttcatgaatcagttcggcagccttcctcaatcggattaaacggatgaagtccacaggagacagattggaaagcatctttattttccgcagcagactggaacgactcatgcccagaatctcggcaagatgctctacgttcagattggtatctatgatattttcctcgatggtacgaatcactttattcataaactcttcatccaccttattcatctgcatcttattcgtcgggaagaacggacgcttggagaatgcttcgcgttctttctgacggttatacagcaaggatacgatctgcgttttgaggtagttgaaagagaacggtttctctacataggcttccgcacctatcttcaagccgttgatcttgctgtcgatatcattcttggctgtcaggaagatgacgggaatatggctcaggtccatatccgactttatctccttacacaactcccacccgttcataacgggcatcatgatatcgctgatgaccagatcaatccgtctgctcctcaacacttccagtgcttcctgtccattttttgccgtttccaccgtaaaaacctccagcaggcgttcggacataaattccagcatggtctcattatcttctaccagcaacaaaacgtaacttttcatttccgcctctaccggcaccccttcacccagggtatctgtctcgaccgttatctcttccaacttgggcaaagaccgcaaggtattttcgaccagaggaacagaaagaacgaaagaattatcttcatgctctgagtccagatatagcttgcctctatgaagagatgccaacgaacgtgccaacggaagtcctatgccgacaccgaatgaggcggagtcttttttcgctgcctgatagaacggttcgaatatctgctgactaatctccgccggtatcttatcaccgtcactggtcacccgcacaaggaatgcctccgtctctctctgcaattccacgcaaatagaatgacgggcatattttaaagcgttattcaaaagattactcagaatcttagtaatagcctccttatcaacgaccgcttctatggattcttccggaatatgaagagccagttctttgttcttcttggatatagtaggttcaaagcgtgcaactgtttcacgaagcagcgacgtaatatccacacattccatcgtcatctcaaatttatgagcgcctatcttctgaaaatcaagcagctgacccgtcagtgtcagcaggcgattggtgttttgcgtaatcaccgacagattcttctgaatcttagggtcggcaatttccatctcctgcaacgtctccagcggaccattgatcaaagtaagcggagtacgcacttcgtgggcaatctccgtaaagaaattgaccttagactcatacagctctttttctttctctatctcgaacagtttctgacgctcttccatttccttttccttccggtgtttataccagaagaaccaggataccaccacgcagacaagccagataaaatagaatacgtatgcccaaggggagaaccaccagggcggtagtatttcaatagacaaggagcgttcgacaaattgccctccattatcgttactcgttgcctttacttgaaaggtatattgtcccggaggcaatttcgcatacgatatattctgattggtagcggctttaatccagtccttgtcgatcggagccatccgatagtaatattggttagcctcagcggtagaatagctgagtaacgccacgtcgaaactaatattcgactcatcataattcaatacgatacgatcggtatgcgtgatacattccttcaaaggtgaatcggcagtatgcactgtcacctccttattatatatactgaatttggagatataaataggcggcacaaaatcatccgtcttcgcttctctcgggtcgaaagcgaccagtccgtctatgcccccaaaatagaatttgccattgcgcgccttcaaagccgatttataattgaactgattccccaacagcccgtcttttgtcgtaaaaacacgtatatcattcttgtcgggatgaaagcgaacgagtccgcggttcgtcccaaaccatagatttccttcttcatcttccagaatcttgtaggcaacatcgtcgggcaatccttcctttattgaataggtgacaaagttatccttttcttcattgtaatagcagattccgccccggtcggtagaaaaccagacacgtcctttactgtcctgcataacggagctgactgagtttgaactcaacccatcgggttcattttccttgctttcatactttttataggagtcggtctgaggcgaatatctccacacgccacttcccatcgtggcaatccagacagaaccgtctttcccttcgcacagatcgaaaatccagttgtatccggtctccttgacattcacaaaattaaatgaaccagcctcggcaacatacagtccccagcctgttcccagccatttacgtcctttcctgtctatatggaaaacatatacgctgccttctccgatctttagttccgacggagtataatgcctgacagtgtatcccggaacctgaataacgtcaagtccggctttgaacaacccgcaatatatctgatcctgaaaagggactactgccaaagttaccagatgatttccggatttatggtcctttacctgccttatcacaccgttctctacattcaacacactgattcccgcatcttccgtaccgatccagatattgcctttcacatcttccgccagttcacggatacgtttggtattcagtgaatttccggagcttccgggtacgaacttatcgaattgcagattccggttgggtaagtagttcactccgccaaacaatgtcccgatccatatccctccttcactatcctgacacatcgaataaatcatcttatccgacaggctgaacgaacgcatcaggtcttccttcaacgaaacgacttcgttcttcttttcatcaatgacgtacagtccattgaaggttcccagccagattttacctttcatataggctaccgtagtatagaacgtattatcggctcctgctacttttatatcttccaagacatgggatttcgtattatattttatcaattccccttcattggcagccattatcagccaatcgccatactcgcagatagaattaatattcttccccaccaacggacgtccgtccctatcctccactatctgttcaaacgaatcattctgcggattataacgacagattcctaatccccagaagccaatccagacttccccattttcacggacacaaatacaattgggagattcctgcttaaattgtctcctattgctgatttcataaaaatataattcgttgtctttataacggaatattccctgatcggggataataacccatatattaccctgtgtatcgcctacgatggccgacacccagttatccattgttttaccctcttttgtcttttggtttatatgggtgaatacatcagaagccggatgatacaaatagacacccctgtccgtacccacccaaagtgtgcggttggcatcctcatacaaagcggaaatgttattattgcctttctttaactgatgatcttcgcagttcatccgcaggatggaagtaccgtcaaaacgattgagaccattcttcgttccgaaccacataaaaccgtagctatcctggataatcgctttcacgttactcgacgaaagcccgttatctccatttatgtgagtaaaataataactagaattctcttctccgcttaccttttgcagaaataaagtaaccaatgccaatagaatatacaatgtgttcctcatgatcatattttatttcggcaacaaagataaggtaaatactcttaaatagatggaaggaaattaaaacttttgcatttagaggaataaccgtctgtccgctgtaagaatccagactgctgaatatcaaaaatgatcaccgtcttcacctcccttagaaaaagaataaagcacaaacttgaaaaaagaaagccgttgttctttcattttacttcatatctgacagatcacagacgccatacatgttcactataattaccagcattttattttattccaattacacacttccaagcatacgaaaataattacagttcaatgcataaacggcaaccgggtttataataaatactgtgatcgtttattataaacgtccccctcgtttattataaactttaaaataggaatttgtagaatctggattgaatttataatacaaaaaaggctgcaaaactcataaagttcgcagccttttcctatatcggagcatcctatcctcggctatacgtcagagagataagtactatttgttactatattataccaccacagccgatgattccatactaattttctcattttatttatcgttcttatattattcagttcaggtttggaactacaaatatacaacaataaaaagcgtttgtcaagtgtttaacggataagccatgagaaagcacctctcccccactggaaaaagatgctttcaaacaagcaatagcgaccatcttcacagatgactatttttcgaggcactccgttaccgaagttatgccccatgagatttatagatgcttatgcatctttcaactaattacaaattgttttataagtgtgttttttatctcatctcatccatatttatgtaaaagggtttatttaatcaccgttatcactgcacggcttactctcggatcatcatagaacatattgtccacaccaccttcataagttattttcagttgcgatgccggtactccgaactcattgaccagacagttgtagactgcttccgcacgagccttgctcaaaaactggttaaactccttagtccctgtacccttatcggcataaccgataatcgtatagacagcattcttgttttccttcattatcttagcctgaaatccgatatttacacgagcttcattgctaagagcataccttgatatctggaaagtgaccagataaggagcagagaggatattcgtttccaccactctttccgtaaccttattggaagttgctaattcgtctttcagacgattgttctcgtcattcatcgctttcagttgttcgcgcatcagacgtagttcttcatcactaaaggtaatggtcttgacagtgctgcgcccccatgtacgccgtgggaatttataagtaactcctactgttacggacaataatccttcttctttacgcccgccacgttcaccgtcaaactcatcctttgtcgcagtaccacgcacatccagattcaagtcgaacgcagaactcagacgaaacgagttgatcagaccgatactggcattgaagttacgtgcacgcggactttcccatgtgagtatccagcctaaaccgacatagggagttacagaccaaaaacgtttttcattataaccacaaagcagattcgaggcattgaacagcacgtctccatgaatattcataaagtcgaatttctgttcgtccagccattgtgaagcatcgtacacttttccggtagagtgactgccgttctgtgtagcacctttgatagtcagtccgctatacatgaagcgtataccgatgccgggggtaaaccactttccaaaaccgatgtccaatgccggactcagacggtcgccaaatttcatctgcatattatggtcaccgaaaaagatcagtccgccaccaccggcagttacaaaccagttgctccaaaagcgattggtttctactttatatttatcagcattttctacgattgtagttgtcgtttttaaagatttagagtagtcctcttgtgcataaacactcattcctgttatcagcaacaaggccgatagaacaattacttttctcataagtgattcttttcattaaaattcaatataccaagttccaactgcaaagttggggcttttttttcagtttatcgttcacataaaatccgataaccttctcactttatacggaatcagattaaaagaccgtttaattttcaatatagacattacggaacatctgtcagagagaaatgatagcattatttccgggatttctttttcttccgtccaaataatcccttcttcttttccgcattcttataaccataaccctgtccataaccgtaaccataaccatagccgctactgccttttttcgtaccattgagaacaaccgccatattagtgagtttgtgttcctgatacaatcgttccaactcaggcagttgccgccggtcgatttttccgacacgcacaataaacaatgtcaagtccgaaatacgattgacaacggaagcatctgccactaatcctatcggcacattatctacaatgatatagtcatataattctctgagtctatccattaattcatccagtcgcctactcaacaacaattctgtaggattaggcgcaatgactccaataggaattaaatcaagcccttcaccgaaagcatcccgcagaataagatcgtctacaacaatggatggattggataaatagtgtgctactcctttgacatgcttgctatgcgccatctcactcattttcccttttctaaggtccagatcaagtataagaactttctttttggtctgcaccaaactggcagccagattaacagaaacaaaagttttgccagcccctatattaaaagaagtcaatgtgataattttatggtcttgcgcctgtgacagcataaaccctaaattggtgcgaaggatacgaaaagcttcggacaacggatcaagtccccgtgcacgcactacaacttcgtgtgcatccacagacgctttggctgtctgtgggatatccgcaaggaatggagcactgacaacagcctcaacttcttttctattatgcacccgggtgtccagcattaaaatcaataacagaatgacagaaggtacaatgataccacatcctactccgagtatcatctttttatatttattgggagagatcggcaagttacttcccgaaaccggatcaaggattcttgcattattatccaccatcgcctggcttaaagcgttctcctcccgtttattcagtaggaatatgtacaaagattcctttactttctgttgccgttctatagataacatttccctttgcttcccaggaacggcttgcactttttgacgcacatggctctcctgacgcatataatcttgtttcttcagtctcaagcttttagataaattatctactgccatataaatattttgtttcatcgtctgcatgatacgattcaactcctgaacaacaggattattgctgctactgccacttaccaaacggttacgacgcagcaacgtttcattatagcgagaaatctggctctcaatactaagatcagacagtccgatattactggggatcagttcgtcatccttgtttgaatcctgcaaatactgtttaataaatgataccaactgaagctgagtatccagttccttgattgatgattcatattgcctgctatcttgtatatacatacctgcaactgtattaatatcaacgccgttattcgctcttttcagatcctcaatatcagtttccacactccctaattcatgctcaataatctgaagacgctctttgataaattctgccgtattcacggaaatacggtttttatcctttatggcttcttcgttataaacggtaatcaacatatcaagaatatcggctgcccgtgtaggtgacaggtcattcatagtcatactcagcaaagcggcatcaccactcatctgtctgattgtcagattagagagccagaaagcgaccatcccttcccgggacttactggtcaccttgattggtctgtcaaaataggattcactataattttcagcagtaaatacaatcagttttcctaatggcgtatcaacagtgtcattcagattcacagtctttcgttgttcgagttcatcgagcgaaaagtctgccaactccacctgctgtttatttttaggtataacagacaaagaacacacttcatccagcccagcctccagaaaggcaacccgtacaggagagtccgtatagagttctctgggacgcaggccatcacgcaccatgtaactgacatccgcatgcagacgatctatcactttccgcatcaattccttcgacttgaattgcagaatttcactcgccacattgacttggcctatgaaatcagcgttattcaactgcattgccgaccgcgaattggctggtgttttaatcattactattgccgtgcggctatatacaaacggggtctcacagtagctataccagaaatatcccccaaacagcagaatagaaaggacaaaccatttccaatgagctatcaggtatataaaaaggtcaacgatattaatagacttttcctcctctgtcaaagccatcttcttttgtttttccatatgcagtaatcggctattattttaataagacagttattgtagtaatcaaacttaaaagagtcagaccgaacgaataaaaacttaatgtacgtctttccttcgtattggcttctgcaaacttaggatgtacatataccatgtcattctgctgtaaataataacaaggagagtagaaaatgtccgacgaacggatatcatgcatatacattctgcgttcgttcccttcttcgcgaatgaccgctaccctgtccaaaagagcattggaagtcactccgcctgttcgggtgattgcttcgagcaaagtaatccggctatcatctatctttaaaacctgaggactttcaacttctcccatcacagtaatctttatattcaaaatatcgataaataccaaaggatcattgatcagattttcatcaatcagccgctttttaattagctcagctacttgcttacatgataaatctaccactttcagttttcctaaaaccggaaattcgatatatccattcaaatctaccatataccctttttcacatttttgcatatcggtaccggtagctacatctccactggaagttacctgaaagtttcctccggtcgatatattgaaaggaaccgtcagttcgggattccgtgaactgacaacaatactaagccggtcatcccgttgaatcttcatttccggttgggcattcatcggataagataacgattctttcatatcctccagataaacgattcttttcgtattgatgcaagaagtcatcaataacgctgtcaaaagtactcccacatacacatttcttttcatatagcttgtttttctttgattacaacttttcggaattcattcttttttgttggccggataatcggtttcagaactgtccaatactcccgaataaagattcagacatagttctgtcattagctctttagtaaacatagtctcataacgtcttcgcgctcctcttgctaactcttcatacaggcattcatctgtcagaacagcagtaatcgcctctgccaatgcatctgcatcttcaggttttacgttaattccggagaacctgtttatattcacccaactgactccggactccgggatattcatagcaatcacaggctttccacaggacattgcttcaatctgtacaataccaaaagcctccgttttccaaatcgaacttaaacaaaacagatcacaggcaccgaaataatccggcagatctttgtcatctataaatcccagcagttttacttttttcctcactcccagttcatcaatcaaggattgcaaatactcttgaaggggacctttgccacctatcaatataatatagtcgtcattcaacttttgagaagcctttatcagatattcatagcctttgtactctaccagacgtcccaaagagaatatgattttctttccggcatatctttcttttatttgtgccacccgcccgggaaccggcttcatttcatctattccgataggaacactgataactttgcgctgtatgttttccaaaaacggagattcctgtacataaacgggggtggtgccaacaattacttttgctcttcgaagcaaccaattttgtaatggtgaatagagcttcaacaacattttctgtttcagtatatcactatgccagtgcaggactaccggacctttgtaaccagacaggaataatgccagacatgccattggatccggatgatggatatgaatgatatcatattctttgtttattttacgcaaccggaaaatcatagccggagataacatagtagccgccacttttttccaggtggacacacatagtatacgtgcataatcattcaataatagattctcaggtttctgtttttcggccgaggcgcatagcatatcacaataaacctgtctctgtgacagtcccattgtgatgtcatacatcactttctctatccctccccttatcggatagaatttgcctatttgtagtattctcatttttaataaaatatctatttcttactcttcataagtttagtttgtcacttaccgcatatatagtaccggactgaaaaaattaatttaatatagaatcgaataattcccgccaggatgaagcgaatgagaaacgtttatcagaagtaccgatactcgttagaaaagtaaagtcatcttcacataaccgtttcatcagattcattaattgaaccgggtccgacaatttaaaaaatgcagtttgcatacttccagcggcagtctcgtgagcatacggaaggtcggctagaagcatcggcttacccgttgccataaattcagatacgggtaatccccatgtttccacctttgacggaaacacaaggcaatcaactgcatgataataaccaaaaagtttttctctgctcatgaatcctgcgaactctatcgaacttaccgaaccgaactttttatataaccactgtgcatatttattttcttgtccgctaatagtcaagaccactttgaaccttccttttccaagctcttgttccaacagagaagcagcgtcgcatagcagctcaaaattcttatggcaatctggtgtggcagcataaaagaatgtaaaacaggaaagttctactatttctgcaatcacatcattctctttacgttccggaggagctactatgaacttttctttttttacccccaacatccggctcaatccggaacgtaaccattcctgttgtacaatcaggtaagtattccgatgcacattgatccgataaatccaacgggtaaataaagcaaatagaacaatcttatagtcaaacagaaaatccctccaactccatttataaaaagggaaagaagtctggcaatagacaacccgacgttcagccaccacccttggagtcgcatcatgaagagacagccataaatatacaggcattattttttgtgacaatttatacattgtcacatattcacaccacaaacgtcgtccccaccctttgataacgtccggcatttcaatatattcaatgtgcggatagtcagccaattctcttttatgtaccaatgcaataacccgataattgccgtcggctgccaaagcagaaagataacataagcaatcttgcaatatcgttaatgtacctcccttacgtaaactaaccgctgagacaacaatcgtctttcgcttgctactcatctttgtgatactaacttatcgaacatatcaatccaacattgcataattcgttcctccgagaatgtttttgaattatggtacgcattcattcccatacgtttacgcaaaccttcatcttccatcagtctcattatcctgtcggctaacatcggaagatttcctaccgataccaaaaaaccatttttaccatcagttattacatctccagggccacatttacaggcaaaagaaacaatgggtaatccgaacgactgtgcttctaataataccataggcaacccctcataacgagaagacagtaccagcaaagaggcttgtcggtactcttcttctatctgtccggtcggtggtttcaaaaagacacaatgattcagcctttttctcttaatttgtcgttgcagacggtccgtccattctccatcaccaattatatccagtgtccaagcaggttgggcacaatgaataatttcccatgcttctatcaaatagtcaaaccctttctgatacccatatcgccctattgcaatcacttttcgggctgtaaggggagaaagatgaagttctgttgtagaatgactcaatgcattggggatcactatcatattggacagatttccccaatatgccttatcctcggcagtcagtactacaaaacgatcgtatttcctcacggttctttcatccatccggcttctccatcggtctgcaattttccagactcccttacgtccatattgcaaacgcttataacgggaaaaatgaatttcaagtactttcttactgccatcatcaatcttccatagaaaagaagcatcattgcagaacatagaaaccacaatgtcagccttaagttgtttcagacaagccgtcagcctcttccgatgtttccactgtttgaaaggataattggctaacttattaagaaatgacttcccgttattttcttcatagttgattctcaagtcacagcagttgatacgttggtccagttcgaaaaaggattgcttttcacgttgatctgtagtaataataacaacttcatatccatgactgaccagataattggctttatttgccaatacccgttccattcctccggaattgtaggttccggctatacagtaaacgattttcattcttctataagaactggttccattttccagtccagacaataaaataaagcataaataaaaaatagatcagtagctactttcatccagataatgaaactcaatgataaaagaacgaaagaaaaaagccggaaagaagggaacttccatgcaaacacacaggcattatacacaaaaaacaaaacaaaagttccgaagccaattaaaccgcaatacaaaataaaacggcaatagccaatatctgtgctatacacaaaattagcaaacaagcctgtgccaattatccaacttttaacatcttccggccaaacccacatcattgtatttaatttgtccgttgaatccgttcttagttctcccgtttccacccagttaaagaaagcttcaaaggcaaatctgatattcttgtagaaaaaaggatcgttattatataaatagaccgataacatcgtaaatacgattaacattcctcctaaaatagaataaagcctgatataacgacccttgattaccaaacggaaaatacctgtagagcatattaaatatactattcccaggaataatccgacagatgtagtacgagaaatcatattaccgataacagcaatcacgaaaaaagcgaataaacaggcaaaagttttccacctaacctgctttacaccctcatcctcacagagaagatagactatcaaaagaagcacaatagaaaaccttacaccggcaggatccaatgccgcaccgataccatacaatcttcccacttcctgaaaaaactcttgcccttgagagatataggtatctaccaaagcccggaatgccgagaatctatcgattaaaattgccaatatacactgagacacgcatacaaaagccgaataggctatgagcaaatttaatgtcgccttaccgtgaaatgcgcgaataacataacaaaccacatatgcacctcccaaccacgtaaaaaaggacacgaagtaagtgacataagaataatcatctgtatgattatagtcagcagcaacaaagcagataaatgagaaaataaaagcaaagacaatagcacccagcaaatctctcgaaaaagtaatccgatgtttttgaaatccctgataagctaccaaagcaatacctaacatcgctaatgccattttagtgttcagttgcggtaagacagaaaaactgaatggaaaataatagccactcacaaccattgatatcaataacatagtcaataaacgcaccattctccaactatattatttataaataataccataaaccagcttaaataccgtccgataatataacctcaacaaaatgaaatatcgttttaccgccatccactgtataatccgtgttcttaaaggaagaagtttgttattcatgacatagcagtttgcctcaggaaaacattccagccattgttcataatgcgatttatcatctgttataagaagaggcaactttatattcaacttaagaaaaggaataaactctattaatgaatccgcatatgcggaagcatttacatatttttccacctcatatacgttatttgctacttgtattatatgctcttgtgaataaatctttgtcagtgattccggattactttgtctataatggtaaaaaggacgatgaacaatgccaaccttcccggcacagataaacaatttcatcatcaccatcatatcttcacccatattcaaaccttctgtaaaacgaatatcattctctacataaagagaacgacgaaccagaaaaagccataaattccaccgcattaccccacccatcatttttcgtaatgcctcaacggaagtagtatatgccggctgcttcatatagcgtgcattggaattgaaagtcaagtaccactcgtgccccactatatccagtcctttgtgattgatttcattgaccagacattccaatgtgtgcggttctatagaatcatccgcatctacataataaatataatctccggtagcacacttcagggccgtattacgtgccgccgctacacctcggtttcgttcatgttgtaatattctgattgtaaaatcgatctctgcaaattgttccgcataagatgttagtatatacaaactttcatctgtactacaatcatccacaaataaaagctccaaatttctataagtctgtttatgcaaggattccagacaatgaggcaaagttactgacgcattgtatacaggaatgatcactgaaatagttatatttccaatattcatttgctgtttcttataatttgagttttcattcgtcctccaaccagcaaagcaagcatattgggggccattctattcaaaaaataatagagaccgagacaaacacctaaagtaataaaaggtattagtaaataactaagcattaatcctcctccggagtctgcaagagaagtacgggagaagaagccctttgtccagttaatgatgtatatttcgtgggctgcataaataaaaaagactgtagccgataatttacaaaacagattcttccaactttccttatctattaaccagtccatcaaattgaaagctgttattatgccaaacaatatatatattctaacaatatacgcatgaagctccctcccattacaaatgatagcgcaacataaaaacatgagagtgattattgctgtcacataccggaacttcgaacaaaacgccagaacattctttttataaattcccatataggaacctgctccgaaaaacataatagctgtcatactcagtcctgcaatatttgtttcccaaacagataaatacagagcgagcagaataagtaatccatatattttcagatacttgaagaaagcatagaataatggagacaacgcagacatacaaatcaaatcacgcaaaaaccacaaaggatagttcacaggagtatgccaaaacaacatatacaaagaattattcctgacttcctgtagttcctcccccggttccattgaaaaaagaaaaataaacgcataattctttatatagacagccaatatcataagtatattccataataaataaggaagcaaaaggcttattactctcttttttaattgaagatgataaaaatcaagactccatttctctagtttgcgaaagaagaagaaaccagagaagaaaaagaataaaggattgcgtatccgggacaaattatgagatatgccttctgaaaaaagatgatatacattcatttctgagaaattcatctctatagggattgatgtcatgggaagcacatgggcaaaaagcaacaataccatcaacggaaatctcatagctgcaatcacttccgattgtcttttctcaaggttttctttcatttactgatttcattcagaatttgatcaacaacttcgatatgccgtatactaaatttccgggcaaacaatgcttccgaattcatcaatatttcaaagtctttttctttccactcttccagctggttatctttccacccaatcatccgcaaacaaccgtgtccttcatcgtgcatatcgtagactctgtcgcgaaaagaagaattccagcaaatagtctgcacaaatatttcgtccgcacaaaaagtatgggtataaactcttcgtacctctttttgctgctgcaacaaataaccaacaagctcgttactaatacttagccattgagtaccttttctgaaattaatatccttattccgccgaatcccgagtaaagactgcagccggacacatcctgcacgtaaaacacgctttgttacagccaagccgccttcagtttccttaaaacttttggggaacaaatgccatctacaaactttacggtcaatttctttggatatatttccctgatagtagccaacaaactcttttcccgcatttttttcaaaaaaacgatgaatatagttctgtgttttaagaggcatatcaacacccgataacaaatgataataactatattccccacgtcgataagcttcatcgaacaatgcaaattctgcatctactacacttatatctccccaacggacatccatacgttcctctaaaaaagtaagtttagcatacgatgtccggcaatccggatagtgattcagctttcggtcaaaatggatatagatatcatttcgttcatcatcaagagcctgtatcagtcgtttcagaatttcaaactcattatgagctataatcaaataggcatgtttcattattcttgatcagcggtgatatgaatcaatattttgtcaacaatatgcatatccgtatagctaaacttccgagcaaacagacaacccgaactgattaattcatcatagtctcccaaatgatatatacgaggattggaaccaccatcaaaatcacatttcaatagtttatcatcatagtatatacgatcttttaaatacgatttacccaattccgaggggataaaaaactcatccccacataaagtaaaacgatattttcgcaatacatcttttttaatctgcaataaataacctatacatttacctgttatactcacccaattagccgcattagtatatgattgattccgattccgacatatatgcaattctttttgaatacgaatacatactctccacaatagctgatttattcttcttataaaaagaaccttatgcataaaattcttcgtaaagaagttatatctccgcattttaaggtgcgtctgataatctgagtttgggacatgcaccaatacttccttatcttttagaccttcaaaaaaatgatgaatatagctttgggacttcagaggcaaatgtaccccggaaagcaaatgataataatcatatcgatcctgcataaaagcagcctcaaacagagcatactccgcctttatctgtgaaatgtgcccccaacggatgtctgtccgcttttgcagaatatacaaatttgtatactttgtcttaagcaatggatagtttttcacctttttatcaaaatgaatatagatatcatttcgttcatcatcaagggcctgaaccaacttccctaaaacctcaaactcgtggtgagccattatcaaatatgcatgtttcatactgtagtcaagcatttcgggctaatcgtaacaccatcttgagacgtatcattgcagcagcatcaaaataagtcattttgtgaatattgcttagctccaaggcttcttcaaatgacacatcatcataagttccatttatttttgtttgtatgatgtgcggaatgcaatcgtttactatcggacaattttcagcaggccggtagttggctactaattcattaaatagaatctgaaaacaaaaataatcaggcagcgagtcttgagttttccaaaaataaagcagaagatcggttagagttgaaataatctcgctctctttttgagcaaaaaggatactagacaacattcgcaccttaaaattaggttcccagccaaaataataagcataaacattttcccagtacttcttgttcttctcttcatcagagcgctgatacataaaaaaatcagtcttctcatagacagccggaatacttccagtgagtaaaatagtagcatccaaccatacaccaccataagtgctcaataaggctacacgaagcaaatcagaaaagaatgtacgggtaaactgtacatactcacgctttctccaaacaaaatccggcaagtctatatactcagatatagttatatccgtcaggcgaatcacttgataatcatttttgttcctgtcaaccgaatcaaaacatatttgtatgatttcgggtaactcatctttatcaatgccctgtccccagtattgccaaatcactttttgagtacccaacttttttttaggcttcagtgagtatctttctatctcaccattataataagctttaagaataggagcccaaaagtcggctactttcccttgctgtctaatgatagatgctttacgcctggtattccagtaattcataggaataaactgctttactagttcttttaacttcattttctccatcattaatatttcattttgcgatataatgcctggagtttatctaccacaaaggtcccgcaagatgttctataaagcttagataagaaataaatcttcttatcaacctgccactcctttttaataatctccggcaattgttcatagtattgccaccaaagctggaattgcaccgtgaattgattccaaggctttgccccggtataatgtactgtaccatgccggtgaacctctaaccaatcctgttctgtatacttctgcaaaaagaatttcttatattgtggcagataaaaagtcctgatactattataatagggaggcaaggctaatattcgatccttacaaagttgattaaggacatcctgatccggaaactccaaatagtcaacctttgaagcttctataaatttttcaaccatattatccttccgcatcaattccagattcataatcagaaatcctgaattaatatactcattcggattacatcctattgttttcagatggtccaactgaaaatccatagaagcttcaaacacagctgccagataattcattcctaaatcaatggaatgataaagttgaaccaaatcattacgaacaataatatcacaatctatatagatgacttttttatattctggcaataaatccggtaacaacaagcgataagaagccgcttccgtatatttttgatcaatatatatatgctgcaattttccttgaagattcacaaaagaataacaagtgcgtccctcacctattagttgtatttttagttttaaccgttcaggcaattcctcgcttaataagcaaatgacatgtaactctccttccgcctgcatactcgtaattatggagtagagacatgtagctgccggaataaaataatcaggagtaaaagcaattaccaatggaacagaggtctttttcatacaaatatatttatctcacccaatatttaggactacttgtcagacattttgccaaagataataaaagccgatacttccgggtgccaatttttagtttactcaccacgttccatagttcgtccggttctatatatcccaaataccgaaactcatttattacacttcttttttctgcatccgctttctcgtgatcagaagagactccatcacatccataataacagatagtcaaatctatttttttataactcctgtgattcacagcaatttcataaaacatctgttcatagtcggccactatcattaatgtttcattataaggatgtgatttaagtagttccgtacgaataaacaaagactgatgacacacggaaaaacgctgcataaaaaacaatgtatttactatttctggggcactccattcatttataccacccgcatattttaaaacagcatttccacatacaaaatcctcctttaagaaaagaagagcttttttcagtgtatcatcttcataaaaggtatcacctgaattaaggaaaaaacaatactccccctgtgcaacagaaattcctttattcattgcatgataaatacctttatctttctcactaatccaataagaaatatattcagaatatttttgaagcacagaaacactacagtcaacgcttccaccatcaatcacaatgtattcagccttctctcccaaaagctctcttaatactgtcacattagatacgactgactgaatggtagcttccagttgctcaccattattataattaatcgttataactgatatcttcattacttctctacaatacgagccggaacccctactaccgtcactcccggaactaataccgatttcgtaacaactgctcccgctccaattttcactccgtctgcaatatatattccacccagaatttgcgcattctgtccaatatcaacattattcccaataacgggagaatcatccggaaaagtacctttacttccaatgcagcaattaccatgaatcgtacaatttttacctatacgggatttaggatttacaataatagacccataatgataaatcttcaaaccaatatcaaaacaacctgcatttataaagaacccaagacggatacccaaaagattcttctttcgagaaaaataatattgcaaaatcttatttctcttatagttcatataaaattcctctttacgaagtgcacgtatatatctccgaatccaatattgttctgtcctcaagagccaatccatgatatatccttttgaaccaaaaggaaaataatcaatacgatccgaattaaggtattcttttaaagtcaccattctacgtctcttttattaaattaatctgaatccgaaagcagacaaaagctcggatctcataaatatcgcttccatcgttttacataaagagccaatacactatacatatcatgtaatactaaccaattaaacaatttcatttttttccctttcaagagatatttcttatcataaaagacccccttaatcaaagggttagcacatgacttttctaactctttcctgatttctgtataatttctgtttgctatatatacgatatacctatgaaaaaaataaataatgacactataacgaacacctgttaaatcgaaatcatatcgtttttcaagatcagaataagaaattaacagtttatgtaacgtatattccaaatgctcatatgaaatcgatttttgcgacaaatgttcccctacatgatgcacatagatatatccaatatatgaggatactcgcaaagagtgaacacacaataaatattggcttacccataaagtatcctctcctgaatacaaatatgtatcgaaaaacaatttattctttctttgtatggatgacttatacaatctgccgaaaggtaccgtaaattcaggataaatatatttcaacagacattgctttatttcatcgctcccttcgaaatttccatcaacaaataaatagtcattgcccacaggttcagaacagcaggaacactgaacaaaatcgcatgatgcatatttcattagttcttccagatacctctcttgtatgtagtcatctgaatctataaaaaggaaatgttcaccagtatgcttttcaagtcccaagtttctcgcagcactcacgcctgcattttcctgatgaaagacttgtatccggttatcactttgcgcataatcatcgcaaatcaatcccgaatgatcttcactgccatcatttattaagagaagctcaaattctgtatatgactgtgccaaaatactatctatgcacttccttaaatattgcgcagaattatagacaggtacgatgatagatactaatgtttcgtttctcacaagattgaataatcatattgtataataaacatcttttttaattacccttgccggtactcctgcgacaatagtatgcggcggtacgtctttagtcacgacagaacctgctgcaacaatagcaccttcaccaaccgtcaccccttttaaaatgatagcagacataccaatccatgcattatcctttattataacaggagcaaacatgctatttcctcccgttatctggtgattatcagaatcccggataattacattctctgaaatgataacattttctcctatttctatgtgattaaaacaatgtaacttcgaatggaaattaatatacccggaacctaaaatcagtttagcatccggcaatacgactacagttgaaccgataatatcaaaattcccttttactatcaattccgagttagcatgaagaataagccgccctttctcctgtgaaggaatgtttccaacccataccttaccaacaattaatctttgtaacggatatacattatatcggcaatctttttctctgtacagaataccatgcctcgtaacataaataccaggatgaatatattcttgatatttcctatatatttttgcaataaaaccgaatatcatctcgccatctttcttttacaataacttaacagcatatgctctattaacagatacatatcatcacgctttattttcaatagtaatatataaatagataaactcattaagccgcccaataaaatctgtgtaacaatagacaaagatgtatatgtcagcatataagtaggtatattagctaaaagtgccataaaaaaataaggtagaaaatctgtcagctgttcccgataccctaaatgaaatagctttccagtataatatgtattaataaaaatagcaatttgggtatatataaccatagaccagcacatcgccataattccccaagatgcactcaacaaaatcattgttatagaaatagcttttttcacgacctccagtttcaaaaatagatccgatcttcctttaatctgtaaaagagataaatttattgtattcacaaatgagaacataaaagaaaaacataaaagtatcatgatcgggacagatggcaaccacttatctgtaagtaaaagaagtatcaaaggtttagccagtgccgccaaaatggtcataccacaaaaaataaaaatagcacaaactttaatatatttccgataaattcctattaactgttcatcctcattctgcaatctcgacagaacaggaaaaacgacttgctgcaaaattcccattatattactactcgggaaatccacgtaactttgcgctctggtatagtaacccaaagtggaggaagaatagaaccgtccaataatcaacggggacaactgagaatacattgtattaagccaaccagacaacattaacttactgccataaccaaacaattctttaaaagagctggtagaaaacatccacaatggtttccagcaggaaattctccataaatagcaacaatttaccaaagacgcaataattccctgacatactaatgcccaaactccataaccattatatgctaataataatcctatacctcctgaaaaaaaagtggccagtatattacctatcgcgatatctctgaacctcaactgacaatacaaaagattactatgaactgaacatagagcacctatcggtattgtcagacaggctattctggttacattagtcaataaaggctgcttataaaagtccgcgataaaaggagctcccaaaaacatgaccatgtataccaataaactcgctcccagattataataaaaaacagtagaacaatctatctctgtacggtccaacttacgtatcaaagcagaaccaaatccacaatctataaatgaaccggcaaaagcagtaaacactccaagcattcctaacataccatagtctgaaggcaaaagcagacgggccaaaataagtcccaggacaaaacttattccctgcgaagagaaacgtcctatagaagcccatttcacaccggaaatgcccattgaacgaatatcactattcacctctgttttttttcggtataatatcctgttcccaaaatagcatggattatattttctgtggcagactgattatggggcggcaataagtacgacttaaaaaagttttttcttttttctagtaagtaatcagagttttccaatactgtacattctataaaattccggatatcttggatagtctgccccttataatgcaggtcataggctgccttggcaaaagaattcatcgttgcagtatgctcttttccattgaccagatacattacaggtttcaatgtatgatgatattcaatcgtaaaagagccacaatcatgaatcatggcatccgaagtcataaacaaatcaacatactcattggtctccaattgagcattcggcagaaattcccatgccgcataatactcgtctgttttctctttcccccatgaagaataattatatagttgactctttagcaaaggatgaggcttaaaagccatctgaacaggtaattgagtgttctttataaattctaacagttcttccgcaatagataagaaagttgaatagttcaaacagccaccatcagatattgagaaatgtggtgcccaaataatccgtttacgactcttatctgtttttttccacttatcttcatgtttctcagtcagaaataagtctgttacaggcaagcccgtaactacgatatttgagaatatccctgcaaactttttcttcaaatcaacattagcagactcattttcataataattctgccacatcaatctaaagaattcattatcattagcccaatctgtcagtaagctatgaaaagcataatttgtataacaaaataaagcattcatatttttataatacaaaagactcttaggataaaaagtataaggtttttgatagaaaatgatatccggtttcaatttcttccgaatattaatcagttttccattttgataaggataagtacaagcatacccttttctacaaaataaattaaaacatgaatcaacttcttctttcaacagagttttttccttctgttcatcaggtaaaacaagaatagaaggagtaaatctgggatgttccgccatcgctttataaagacaatcgcttttccaggtagcactctccgccacagcaaacagaactcttatatttttctttcgtcttaatctcttaactttaaagttcagagtattcttgtagagatatttagcacagtcccatttaaaagagcgcagcaacttatatatatgttccatcaacagatattaaagtattaagtgtatgtgaaacgccttcttcaagcttccattgggggaaccagcctattttatttattttctcagtattaaatatcgcctgtgatataataggtttattcttcccggtattatccggtaaatcgaaaattacttctcgttcacttttcagtgctatcatttccgcaaattcgcggatactgacattcgaccggacgtcagctatattataagcattctttgtttttccttttagcaaaacgtaaagaagtgcaaacacacaatcaaccacataacaccaggaacgctgttgcaaaccagaacttctcaatattatattttcacctgccaatacatttcgtataaactgcgcataggcacgatcatcttttgaagtgtaaaaaggtccataaatatggcaaggacgtgctataactgtttctatctgaaattgagctgcataagcaatacacaaagtctcagcagtccgttttgccgcagggtaacatgcgcgtaaggaagcccaatcgagagaaccactgtcttcttcgcgaaaaggaattccattcccctctccatacacttcaccggaagaaacatataacaaccttcttagattgtgttgctctccgtatgaaaacagattgtcaactcccaatatattcgctttcataaccccgaccggatcattatgaaaggcggccggccccgcatagctcgctgcatgaataatatagtgaaaatcaatatcaaatggaatcaatgctgtcacatcacattgtatcaaggtgaaagattcatcatccttgtatcgcatgaaacaactttgcgcataaaccaaatcccgtacacctgcatatagatgaaacgtcttatcgggtaactgcatcagagtatccaccaacgcccttcctatcagacctgaggcccccacaatcagaatatttatatcagtcagaatttcccacggcagatgcaaatcctgcacttttctgatatcgtcataataagtcatcatttcagccagtcttcttttgacgtttgcctcaaaaccttgaaaatctccaggtcttccgtagtcgtaatctttatatttcgctcctctcccggaactatatgcatttcatatccgcccaattccgccaaaagagtacaagaagatactgagtttatgataccttttgattttgcctgctcatggacatttataatattttctaaccgaaaagtctggggtgtctgcgttcttatcaatttatcacgcggaatacttgtcacagaacaaaagccatcatcactttccaaaatagcctccctacactgaataccagtgatagcataaccatactgcttacaaattgcgatattggaagatataatactctgagataccagtggacgaaccgcatcatgaatcaaaaccagatcatcctttttgacaccgttcttttttaaaccgtatatgccgttactaattgattcctgaccatttatccccccagcaaatatccaacgtaactttgatacattatactgatgagcgtatgaagacaacacagtttcccatccacctaaacaaacaacagcaacagcagttatgtccggatgtctttggaaagctaacattgtatgtacaataaccggacaattatccacatgaataaactgttttggaatatcttgtcccatccggttgccggatccccctgcaataatcaatgctatattcattttagtaacagatttgaatttaatactattataatgttatccattcttctttcttttgcagaaatcctttatctgataaaactcattcacgcacaactttttatttaagaatagtctatcaaaccacattctcaatacaaaacgtaaaccaaaatgggaaattaatatcttcgtgattctcataaacatagaacactctttcacaaccagaaaccgtcccattggacgagagaattgtgagaggatgaacattgcagcctcatccgtcttctccacatcataaatagcttctcttgctttcaaagaaaagatcctttgatgatttaagtcgagtccagaccatacccctttttcatgtattctatatactcccattacatcaggcatacaatatcctttcccatttttcaaaatagcatagaacaaggcaacgtctatatatattgcatatttcgagtatgtatccaaatccaatgccgactttcggtatacgacacttaatggttgaaataaccaacctccacgaatcaagaaagacaaatcaaaagacatcccatcagataaatcgccaatcggtttgatctcatcattcatcaccttctcctcttttaaacatattctgtatcgatgtgaacaaataacataatccgagtaacattctaaaaaatcaatctgcttttgtaatttataaggatcagtccaataatcatccccctcacaaaatgctatatactcacctttagcccgagaataattataaacaaaaccaaccttcacaccttttgaatattgattctcagtttgatatattggttttattatatccggatattttttctgatactcctcaataatattctgagtaccatctccagacgcgtcatcataaattaagatttctattggaaaagatgttatttgcatcacaaaaccatccaaacactgacgtaaatacggagcatgattataggtcagacaagaaatactaaccaatgggcattgtgtcatatcgaaaatcgtataatattatataatacacttatattcaatcttaaggaatcactttcattgcttcacgtatatgtttaatagccaacggaagtaatattatttcttcattaaaaactctgcctcccaattcccatgcagactcattctccatcacaagtatttttttttgagctattatctcgccagtgtctatttccgaatccacataatgaacggtacagccggcatacttctcatgattcctcaaaatagcttcttgcactttaaccccatacatgcctttccctccatattttggcaatagtgaaggatgaatatttattattttacgttcccacttttcacaaatccatttgggtataatcggtagaaatcctgctaaaacaattaaattcgtatctatggggacaatcttctcaaactcctcaaaaaaagacttgcctaaaactttcttttctaaaacggaatatgatatcccattttcctttgctatcttaatagcaggacactctctatctactatcagtaacgaaatgtgataaccataatcacattgatattttatcaaagaacgaaaatttcctccaccaccagacgcacacactacaatattaaaagatttcatatctaagcaatttcaatatcttacacaaaaagaatccaataaatcattgacttcatctttggtattattcattaatacatctatcatcgacaaataaggcacaaattccttagtacgcaattgagaatatacttttgggattgtatctacaaaattcagtacaattccatgttcactaaattcctttttatcataaagattctgcccaccgatagcattataataagtatcagcacccaatatttcacatatctgcaagattttatcttttcctctcagagaattatctttcggaatatctgaggacatcaatatctccgtatctattgacaaataactgaatatttcccgaaaactatttgctataaatgccgcaagcctcttatctgagaaagaaatgattcttttcatcagagtcatcgtctgatcaaagttaacagctttggaatagttcagttgcagtgttttcataagtttcttaaaatcatcgcctatcactatttcattgaataacttattctgactcgctttcttcaaagtcacagtgaacatttctttctctccattgatcagtatatgattacggttaacccagccgcctttaatgtaattaacatcatcataaaccacatacttatctacagctttcattaattggaaataaccgatataaggcataaagtaaggttgcatcacaccaagtttcatattctactttcttatcagccgtaacacccgctccatatcatcttcgctcaatgcatggtgcatcggcaaacaaataacctgttccgccatctttgtggctacaggcaaattttctttccttgctgactttaattcacgataagtagaaaaagtactgatcagcggataaaaataccgccgtcctaatacattatattccttcatcttaaaatagagttcatcacggctcataccatatcgttcttcatccacaaatatggggaaataagaataattatgcttcactccggatatatcatccataaatgtgataccggaaacattacgtaaggcttctctataattagttgtagcctggcagcgtgcttcaatggcagcatctacctgttttaagttcagtaatccgtaagctgcccgcacttcatctagcttgccattagttccgggaataaccacctccgtttcaccgacaaaaccaaaatttttcaagtaatcaactctctttttagtatgttcatcgtgaagtaccaatgcacctccctcaatggtattaaaagtcttcgtcgcatgaaagctcaatgtcgacatatcacctgcattcaaaatagattctccctctctctccaccccaaatgcatgagcagcatcatagattaccttcaatccgtatttatctgctatttgctgaatgctcttagtatcacaaggatacccatacacatgcactggcataatggctgtagtattaggagttatagccacctctatcttatcagggtcaagattacaggttacagggtctatgtctacaaataccggtttgatgccattcaaccacaacgaatgtgtagtagcaacaaaactgaaaggcgtggttattacctctcctgtaatacgcattgccagtaaggccgcagttagaggaagagtcccgttggtaaacagactgatataaggtacacccagatattcacacaaagcggcttccagcatctgatgataatatccattattagtaatccatttgcgttgccatatatcctgcaagtaaacatttaactcctccaaagatggtaataaaggggaagttactgtaatctgctgttccttcatggtttgtaatctcagttgttttttcttagtagtaattacctaacagtatcatattctctctacaaaccctaccggcacttctaccatcgcagctcccagcatattaatcctgacggctaccttactttttccatccattgttatcagctcccctgttaatcctgtcaacggccccttgataacttttacctgttcgcccggctggatacgctccgaacacatctcaaccgcttcttccgaataatcgagcataaagcggaaacgttccatttgtgcatccgggatgattgccggagcactttctccgcgcaataccataaagcggcttacagagggaagacgaagcacagaaatacgttcggaaggagctatccgggcaaaaacaaccataggaatcacgacccgctgcactttcttgcttcggtcactccaacgacgtgtttcttcctgtaacggaagaaaagattcaaatcccaatgccgacagacgttcgtaggttttcttctccctgttactctgcacacaaacaaccaaccaacactttttttcatccataataactcctccaattctatcatttaaagtcacaataaggtaccctccaagcgcgctccgctcccgccagtcacatacatgacggctacctgaaaaattttatgtcttatctatctaacttttttccttcttttctatcctgtaaaaaggaaaaagcctagtttatcaattaatagcttcttcagctcctgaaccaaactcgtattgcaacgtccgtctcaacccttcttccattgagaaagccggcttaaaacccgatgactgtactttaacagaatcaaactgagtcaccgcacagaacttcttcacacgaacagaactcaccgacaattttcttcccgtcatcttagccaaagcatcaaagcaatatccacccaacattcctaaccaataggggtaatgtgtagtaggaatatgtttattcaacacctccccgacatgatacaccaaatcattcattgtgaaatccggcttatcgatataattgaatacatgatatccctccatattattctcaatcagaaaagcgataaaagcaactacgttaccgacataggccatcgacttccggttttcaccgtctcctaccatcagaaatcgcccggaagtaatctgccgcaacaaattatatacattccccctgttgccctctccaaagataactgtgggacgaagaatatgaatgttccactcccgatgcgtatcataccactcctgcagcatacattccgcctgccacttactacgaccgtaatcattgaacggatcggccggatgcaattctgatggattatctttgttcaatccatagacagcaacagaactggtgaataccaaacgggcaactccattactttccatagcctgaagcgtattacgtgtcccttccacattcaccgtatagtaaagcgatgcaggagttacgttgtctttatgttcggcagccaataaaaccacaagatcagttcctgccagcaactccgtcagcttctgtacatcctgcacatcagctatttgtgtcagatgaggataaagttcactctgctgcttgtcaatattgagcagttcaatgttcggaacagtctgtaacagcccgatcaaacgacttcccacgaatccggaaccaccgataatagctattttcatatcattaaatttaattatttgccaccccatgttttgcccggataagctctcgcctgtccaaccataaatggaaagcaatccacagtacgatatctataaaaatcacgatgttgttgctgatatattctaccgcaacaatattgaagaagctaaagaacaatgccaaagccagaataagaatcattgcgacataatgagacatccctactctcagaaacttatgatgtatatgattctggtcgggcataaaaagaggcttatgctgaaaataacgtatccgtaccacacgaactacatcaaaaagagggacaatcaatgtagcgaaagaaactactatcgctccttcggaaaaaggctttatcaacggattattcatcgcatagctgattgccagaaaagccatcgagagccccagcgtcagactgccagtatcccccataaaaattcgttgtcttcctttcgatttgccgaacacattgtaatagaaaaaaggacatagcacccctgcggtgataaaggcaaaaacagcatgtaaccatgctgcattataaataaacaagaaaccaaaaaccaaagcccccataccgaccaaaccggaacagagcccgtcgattccatcaatcaggttaacggcattaataataaagactgccacaaacaccgtcagaggcattccaatccaaggagataaagtagttattccgagtagtccatacaaatcattaatccagagtccggataacggaagaaatgaagaagcaacaatttgagctacgaattttctacgatagttaatcctaatcaaatcatctatcactccgaccatattcaaaatgagcaaacctatcatcaacaataaaaattggaaaggtataaatgggtcttgaagataggacgttatttctagtttatacataaaaaacatagatagcactaatagaaagcactgcaccgggacgaacacaactcctcccaaacgtggtactataccgctatgggtcttgcgaccacctacagaatcaaacagtcgttttctaaaagctacgagcaaaatctgaggagtgataatccaccccataaataccgcaactaaaaatgctattgctataaaaaaataattcatcccataattctctttttccaacaaacgagtgctgtcgttttctacttttcattaaacaagaatcatccggcctgattttacagccatactattctatgcgcaaattagtcgcataatcatctaacatacaacacattaactatacataattcccctatactctttactctctattttgtaatagagagtaataatgtctattttgtatatatacaattgattgatagagggttatgtacaaccatatactatatattatgtttcataccctgcatatacataacaggctttaattttattcattataatacattggtaataaagtgattatattagaccatactgaatcaattatgaagcataatggagtataatcgctttgttgccatcaaaaagggaaagatatgagaggggaacaatcaccgaacggattacattacgccagggaacatttgtcatgcaaaaattacatgacagatattgatacaggattcaaatatattaaattcgacactgagaaatgcatagaggaagagtatacccacaaaaattatcttttattttttttagaaggagatttttcagtatactgtaaccaattttgtaaccgcacgtttcatagcaatgaaatggtagtgttgcctaaatcttcaatgataaagatttccgcaacagacaaatcccaaatgctggctatggcatttgatatacctcaaagcaactgtgacaaacttttatttcaaggtttgagctccatttgtgaaaatattgactatgatttcagccctatccccatgcgttatccactaatgccattccttgaaactgtagtccactgtttgaggaatgaaatgaactgtacatacctacataatgtaatagaacgtgaatttttcttcctactcaggggattctataataaaaaagaaattgctacacttttccaccctatcattggcaggcaattagagtttagagattttgtcatgcagaactattcaaaagtaaataatcttgatgagctaattacactgtcaaatataggaagaaccagcttctttattaaattcaaagaagaattcggaattaccgcaaaacaatggatgatgaaacaattaaagaaacgtattttgggaaaagttatagaaccgggtatatgtgtcaagcaactaatggaggtatgcaactttgagtcgcaagctcagttataccgctacttcaaacagcattttcgctgtactccaaagcaattaatagaccgttatcaggcgaaaaccgataatctttaaggagaactgcgggatcgtacaaaaggagagtattaatgtactttttgataatggctattcgcaaaaaatagtcttattttgcaacatcgctattattaagcgattgatatactctctattacaaaatagataccgtttacaaatataagttataaatatgagttttacaaaatttgaagaacaaattcatgtttcatattataacagattggtcacaatacgattcacccgcgccagcgtctcctgatcgaattctttaagatatactctcgtcatttcttctgaagtatgccctaatcccgcactgatgatagaaataggcgccccgctttctcttgccagtgtagcccaggtatgccttgcagtataggtagtcagccggacatttatatttaaccgaaaagtgatcttttttaaataccggttcaccctgcctaaagccaggcgatactgatcgtagatagatgtcgacaaagatgtatcaataattggaaacacatattcactgtcattcgcgtatttatcaatcaatccctgcatctgaggagtgacaactatatgaatcagctgttgtgacttatgacgtcgatagctcaatattccatcacgaatattcttcttttttagaaatacaatatcaacgaaagccattccctgggcatagaagctaaacaaatacatatcccgtgcaatgtccatcccagaatgaacaggtaaaataagcgaagaaagtttcttcatatcatctttattgattgcacgttttatagtcttgcagggttttgtctgaatataagtaaaaggattctcgcttttaggcttaaatccatcccggatagaggaattataaatcgtccggaaattacgcagataataattaatcgtattcctcgccagtccttgtgcattcaaatagtcctcataccctaccacaaagctgaagtttatttcctccatcctgatatccgacttacgcgcagatttcatacctatatattttttcagagaaatataggtgctatgataggcggctgcaataccgtctttccccatcttttttttataagaaatctgtgtttctatatactgcataagtagatacgaacgatgattcttcttctttttaaactctacgatatcatctactaaatactcttcattgttcctttccaactccaatatacgattctggaatcgcttatagtcccgtttcaactcacgatttatctcctttatttctttcatggaataaagcgatgcttcacaatactcaacctccaaagctccatcagccagttgttgctgaaagatatgatacttggtataataaagcaactttcgcctccggtggataaactgaaaaaccaatggaaatgtaccattattaagcattcgctgtttattgagcaataactttatagatgccataattctactttaaacctgttaattttttattcaaaacagtgcaaaagtataaaatgttctttacttatagaattctttaaaatttaaaatgattctttagttgcccttatataaataattaaagaattccaacaataaattgtttgttttatcctaaatcaagcattaattcgtcaatataataaaaataactatttgtgcttaaactcgcaaacaagtcaattctgcattaaaatgagtaaagcttcttatactgttttgaaagttataacacaaaaatacatagtttttctaaatcgtttgcatgtttcctaccttcttaatgttctatttttcgaactacatttaacatgtatttctctaaaaccaatagatcggaaaaccaaaatacgaatatcaaaactgccacaatatatgtatccaaaatcaaaactgctcagatttaattcctcttttttcgaaaaaagagagacttgagtgaattaaacaggcacccggtttatagcccctatagcagttctaagattttgtttacttagattaccgcgcagtatgtctgcgataattaccaacaacaatcattatcaaagaaagacaattgtagttatataaaaaatagcaacaagtttatataaaccagcctatacgtttataataaattccatgatcgtttataataaacgtccccaccgtttattataaactccccaaatgaaattcgcaataaaatcattaagtttttaagacaaaaaaggctgcaaacttcataaagtctgcagcctttagcctatatctggtactctatcacctaaggtttctcaggaagatagtccatacttgttgctatattataccatttaggaatatgattttacttttttctttcatctgttttttataggtttatgctattgatctacaaatatacaacatttaaaagcgtttgtcaagtacctgctgcgttttcaaatatgcgttctttgcattaatgcccacctaaattcattttcatccatgtacacgacctgtcagcattactatgaactaatgtttcggtataggtctttgtagacaatgtggcacacaacctcatcgcatctttattaaatgaacgatttaaaggaatggtaaaagcaagttcataacctcccgacacaacagaaggagtgatttgtaatccttccaactcactattctcccatttccccttattaccttgccagacagttatatcgcctttatatgaacaccataccttataaacaccttcagcaggttctttcaaacattcattctttgtatcaagatagataaaaacaccgcttcctttttgagttccttgtccaccggaatacagttctccatccttaaccttgcaggtgatataaagattatctgcatctttcccgactcctaaacgtaaattacagattccggtatgaccaataaaaataggatagtttacaatatcagaagagttcacttctaaatcccgcattacatgtcctttcatgaaaaacggagcctccgtccccccctgatagttactggtagcaagagctgctatagtattcgcatcccaaacagctacagaaggccatactgcatgctttcccgcaggcacaggaaaagggcgcgtgcgccttacaaagttacgggcattcttgtcacctattgccacttccatggtactataaggcagcctgtcacccaactgatcgtcgtgacgtatatcatccacctgataagaaagtaacgtttctcctgtaggaagtacacctaaataaggagctcccatgtaaatccaatcttctacaggttcgcccaatgccatagcacgatttggagaatccgccaatacaggagacgaccaattatccgacaatttagtacgtacggtgtatggtttgaaagtaacaaacccacaatcttctatcacacaaacgatttcatcgccaaccaccttacttaccggcattccatcacgactacctgcgcgaaaacaaactgtcttataccctccccatgtcttaccattatccactgaggtcatcatggatatttcctgttcattagaatgagtatatggcccctcattagcaaaataaacttgcacctctccattaggaagttgaagaaaagacggttcccaacaaccgtcagaaaaacgaggttccgcttcataaataatctgaggatcgctccacgttactccattatcagtactacggcgtaccgctatagcaaacggagttatttcgggtgtttgaggacgataattacaagcagccagcaaatccccattagcaagttgtataatttctgagttagcgatatttattcgggcagttcctttatcattcgttatactatggatggggaaaagaataacaggatccccccatgtactaccttcatctgtactacagcgcatttcatagcctgtatcatagttctcatatacagccaccactgtattatcctgtaaacggatggaacgtggatatcctcccctagttgccagttgccggattgttccataatcccaaccaatacgaacaccgtcaacaggttctccttttttagctaaataagggactcctggatcttctccggcaccatcagagtttccacaggccagaagtgtaagaacacaaaaattcaagaggctcaataaacgccttgtttttgttttcatgatatatcaacagttttatatataacaaattttcctccctaaacagataaatacctagggaggaaatacagttttatttattcccaatagggagattgtaccaatcctatccgcttatccatttcactctgcggtatagggaacagataatgtttcttttcgaatacacgagaatcacctactgttgaacgtttactataatctaccttattagtagcagttatattcataccatgcatatatccgttgtctgttttctctgcaattttccagcggtgacaatcgaaatagcgatgtccggcttcgaacgctaattctatctgacgttcatgctgaatacgttcacgcatcttatctttgtccaagccttttgccaatcccggcaaaccggcgcgtttacgaatagcgtctacatacttgtatacatcatctacaggcccttcagcttcattcaatgcttccgcataatccagataaagactacctacccggaaaaggatagaggcttctttcattcctcccttaccattaatcacatctacaccttcatcagcagtttttcgcaataagtatccggtacagcaataatctactttggagacattaataccatcttttccaccttgccaaaattccaattggcgaccacgccactgttgaccattaaaattgattgaagcataaaaacgaggttcacgaccgacatacatattataaactcctgccggataatgtttgccagccgttgccgcaaaaccagtttccgagtagccgcttgctccatttattataggcgttccatctgcattatatccgataatcggtgttgaaccattagccatttcataggcatcaaccagttcctgagtaggacaaagaccgctccagcctcccataccgttggctgccatacatttctcctgatggatattgtcactatagcctgtcccttgatttctggcaaagatatattctttattccatttttttgaaggtaggaataactccatatagtttctataaccgttatcaggttcatccgaataatacaaaccataataagaagaaccctctatcttatctattgcttctttggcagccgcagcagcttttccccatttagaatcatctttgggagcaaagagcaatgtaccgtcttcattggcaaatttagcataatcagcatttccattgaacagcggacttgcagcataaagcaatacacgtgctttcaaagcataagctgcggcttttgtagcacgcccatacaaagattcggccaccgtaccactcgcattggtataaatcatcggcaacgctccatcaatgccatattgacaatctgaaactataaaatctacgcattgatcaaacgtatttcgagggaaatatgtcatttcatcatccattttcagcgcatgatccatgataggaataggaccgtgactacgcaacagaaagaaatgcaacattgcgcgcataaaacgtgcttcacatatccacacattttttgtagcttgcgctgccggacataagtctatattttcaagaaacacattacattgacggataccttcataataacgccaccacattgcataagacgtaccctgactggaactaccttcgagcattttaggattccagctaccacgattcatttctttagccatcggataggtccaagtgatgttcatctcatcagatgcaccactccaggcacctaatgcccaataatcattatcattatagttagtttcacaaggaaggtaatcgtaagctcttaacagaaaacgttctgtataaatttcactggaaaacacttcctctaaggttatggaagtagcatcgtccggagttttatccagataatcactacatgaagtcgatacaaatgcccatgtgagcaaacatagtcctgccacctttattttcattttcgatattttcatattcatatttatttaaagttaatctggaaaccaaagttaatagttcgttgcatcggatagttacctacaccgttattcgactccgggtctacaatcttgatataatcaagtgttaatagattttgtccgttacagaacagacggatattatccataaacatcttatcaatcagtcttcctttgaatgtataacctatttcggcactcttcaagcgcaagtaagaaccattacgcatatacattgtggaagtttggtagttattgtaactattagcattaagaacaataggatatttcgcagtagcagctgtttcagatgtccaacgattatcatacacctcacgcagcacattccatgtgccctcaccattcaggaatggataaacagttgctccttccaaaaagaaacttgtcttggcagcacccgtgaaaaataaactgacatcaaaattcttatatgccaccgtaccaccaaatccaaacataatctccggagtacgcgggtcaccaatagctactttatcatactcatccactacaccgtcaccatttatatctttgtatttaatatccccgggacgaacggtactttggaacgtctgcttcgggctgtttttaatatcatcctgatccttgaagaatcctagtgccacaagtccgaatgtctggtcaatacggcgtccccgagcatcttgatattcatacttcggcttcggttcatcattttcaataatcttattacgggcaaacgagaaattcccacgtaatgagtagaataatccgttagcaactctttttttcacttcaagtgcggtttcaatacctttattctccgccttacctagatttcctaccggaatacttgcacctgagaaaccagccaatacaggcacagttttacgagtaatcaagataccgtcacgcttttccttaaatatatccacctgcaaagaaaccacatcgttaaataaacccagatcaaaaccgacatttaactttttcgctgtctcccaagttacattctgattaccggtctgcccttccataatacctgccatataattattgccttctttccccatatatcctgccgacacattcatattcatggtagttagataaaggaaacgggtgctggaagaaatgtcgttacccaccgtaccataacttccacgtaatttcaagttgcttatccaccagttacgattccaaaagtcttcattcgtcaaaacgtatcccaatgatacggacgggaaaaagccataacgcttacctttcgggaactgttccgaaccgttatatccgaagttgaactctgcaaaataacgttgcaagtagttatagctggcacgccccgcaatgccctgacgacgataaggaacggaccccgtacggtctgtattacgcaagtttacataatcacgacggttgaacaaaaacattccagtaatattatgcataccaaatgtgcgatcataattggctgccacttcatagtaaatggcacggttagcactttccgctaaagtcacattcttaatattctcattacgaagtatattatagatggcattgccctccgcgtcttctcccatatactgttttacttcaaaatccttataatattgtttattattagaataataatggtcgtaagcaaaccgtccgcttactgaaagcccttctgttacaagtgaagataaatcccaacgtgcagaaaaagtcccttgcaatgtattccagttttgtgtttcataaccactctgtgtagtcataccccatggattattaccaagataagtcggtgaagcacctggtgtaccatccggattctttacaggaaatgctaaaggagaagtattacgaatcgcataaaagatatcatattgactctttcctggaaaattacgattctgaataataccgccaacccctaattctactgaaagatctttcgtgagatttacatctacacgcgaacgataattataacggtttacacgactgtttgtactatatgcattatcgccattatcgcgataaagcccactctgcgttgtataacccacatttacaaaatagcgtactacttcggtaccaccggtaatatttaaatttgtaatgctctgtgttgtattcttcttaagaacttcgtccacccagttcacattaggataaagataagggctactaccgtttctgaacaattcaatttcttcatccgtataagccatattggcaacgcctgcattatcacgtgcctcattcattaaaccggcatattccgccgcattaatatactccggataacgaagtccggtaagcactgcatattcggaacgcaatgtcactttcggctttcccaattgaccacgcttagtagtaatcaagataacaccattagcaccacgtacaccatatactgccgtagcggaagcatctttcaagacagaaatgctttctacttcttcagtattaatcgtattcatatcacgctcaataccatctaccaatatcaacgggctacgatttgtccatgttccaaaacctcggatataaatgctcgcttgatcatatcccggttcgcctgtagcctgacgagtcacaatacccggaatttgtccgcctaaagtattgcttaatgatggagtagctattttggctatttctttggtagagacattggacacagaaccggtcacactgatttttttctgcgttccataacctaccaccaccacttcgtccaatttactgacttcttcctgaagagtcacatttataattttacttccacttacagggacttcttgtgacacatatccgatataactgaactccaaaattgcgttgctacgagtatcgatagagtattcaccatcaatattggttataactccttgcgaagtacctttcactttgattgtagcaccaacaatcggttctctcgaagcgtccgtcacatttcccttgacctgaaactttgtgccttgtgcaaaagattccgcactactaatcaagcacaccaaaaggacaatgacatagttcaaaagcctcttgctcattcgattatttttattcattatagtattagttttaaattaaaaatgatattcatttatccggtatccttttacttcagaactctcggcttaattacagttccactaatagtaaccactccctgatccgaaatggcaaaatccttaatatacgatgttcgaggttgtatctccgcagcactccaatgagcatgaaatatatacttccaactaccatctttgcattggaacggcgctccatgtcctgtacctactaagccggtagctgcatcaccctgcaaaagtggattcttgctatacttcacccaaggtcccataggagtatctgaggttgcatatccaactccatatcctttattttcataatgattagcagaataaatcagataatacacgccattctttttcaaaagagaaggtccttccgctactttaccttgcaaaagttcccatgatacttcagcttttatacattgattcaaagtctctgtctttatactcatcaagtcatcagtcatctgagccacccatatcacattcccatctgtaaaacgtacgaaataaagatatggagtaccgtcatcatctataaacaaagaagtatcaatgcttttctcactccagatcggctgctttacttcttgtcggaatggaccttcaggagtagtagaagtcgctacgcaaatatgttcttctgctgaatagaacagataaaacttcttcttagactcaacgtaatagacctccggtgcccaaaaaccccatgtaccataagaatcggttgcagatagagcctgcccctcacgtttccagtttttcaaatcgtcagaagaaaagcaggcaaacccctctccggcagttgttcctcctgtaccataagcataatatttattattatagaacatcacgtaggggtctgcaataggcaggtaattagtctccacactaacacttccctgaccattattatctttttcctcgtcatctgttgcactctctccgcagcaagtaaacaaaagcccaaaggagaatagcaatagactatatatttctttcttgaacataaaatatactctttaattttctataccagttattagttctaacaatcattcttctttgattacccgaatacgccaattctcacaatcacctacatatacattaccttgggcatcaatagcaataccataaggtttgttgaatttagcttctgcagcaagcccatcgacatatccagtctggtagcctattccagcatatgtgctcacatatccttcaggagtaatcttgcgaacagtgcgcccataaactgttgttactaacaaattgccttccgcatccactgctatttgattaggctggtccatacgtgaagaaacaccttgaccatcaataatcccccaaactccattacctgcaaagcgggttagattagtacattttttagtgacaagatcataatcagcttttaatataccctgatatggatcacgtccattccaataaagagtctttccatccggagagaaagcaagccctccatatcctccgtcaccacctatattttgcatatttccgtcagcatccggaaacaaaccgaccactaattcattaaattgatctcgcgtaatcacatattcacaagtctcagtagctttattatagcgaaacacatggcgtccccaatgataagtaaaaagtgaaccgtctacaggattaacagcgataccattaatatggggctgagctaatttctctgaaggaatatatgacttaagatctttgaaaccacctttacgggttaccattccgactgcaacaggatttgccacatagttattcgcattatcattgcctataaacaatgtatctccatcaagagagaagcatatactgcgtgcattgttcactaagctttttgtggaacataaagtctcaattttaccatctttcatacgacggatgcggtgttctccttcatcttgcaagaacaatatggcatcatcccatttatcataaaccatcacaataggccattggacagaagcctgaagatatgcaccatcaactgtggtaccttgaccattaccggctacagtgtacacattgcgaatatagccataggaaaataaatcaggataactgtatactacttccccaactctgactttcactacgccactaccactagcttcagccactctagccataatacgggtagaagtaaccgaaatcacctctgcttctttttcattcacccatacttggacttggctgatatcctctccaaaattattgcctcgaatagaaagttccgttcctttggcaccttctgttggcaaataagtctggaataccagatcagaattcttcaatccaccggaccaatccttgtcttctgtacaactagtaaaaaaactagctgccaatagaaaagagccgacacacaaaaaactgtttttcattttctttattattttggttaaacatttatatcatgatccttataaaaggaattagtccataaatcgtattatttaaggattatatacttcagcgaagaaaagcggaagaagagtcttataaaaaaaactaatacttgccaattccttatttatgtatcaactcttctccctatctaccaaacaatatatacaaaatcatattcgcgcaaaaaattagatattgattaataataattaatagcttataaagccagtttctaatctggtatttatccgttacttctatattaattgatctagaagaaagttttttcccaaccaaatagacaggtcaaaaaataagttcctaccttcgagacattcgcaaagttatcggaacctacctgaaaaggatataagaaattaacctgatattattaaattctatccaaaaaccagtgcagagatagtcagaatcagttttagagcaattttataagaatttgttcattgcatgaaatctttcggtaacactccaaattgtttcttaaaacagtttgagaaataagaaggtgaattgaatcctaccatataagaaatttctacaatcccatatcttccatctttcagaagttgggcagctttctttaaacgtatcaaacgaagatactcattcggactcatatccaatactcctttcagcttgcgataaaagttagaacgtcccatattcatagcttccgccatgtcatcaatcaccaaatcggtgttatcgaggtgctgagatacatactcgttcaacttctgaataaaaacttcatccgccttcgtttgagccatcgtatcggcctttataaaaggagactctataaagcgacgccgcaacctttcacgattacttaacagattggcaacattgacacgcagatattctacagaaaaaggtttctcaatatatgcgtccgctccttgttccagtccttcaattttcgactccagtgttgttttggctgttaacaatattatgggaatatgactgtagtctaaattagacttcaaatgctcacacaattcaagtccatccatttcaggcatcattatatcacttatcacaaggttgatatactcatgttcaagtacttttagcgcttctatcccgttctcggctgttataacatggtataatggtgagagctgtcgggcaacaaaagccaacatatccttattatcttctactatcaagaccgaagcaacttcctttttatccttatcagaagacattatacgtgtttcattatcttcttcatcatacactggcttttcacgatgttcttcttccaaaacgtccgaagccgtctgatgctgtatcggaatggaaaggatgaagcggttacactccatatcttgatccatcgttaacgtcccttgatgtaattctgccaatgaacgcgccaaagccagcccaatgcctgttcccggaactatgtcttttccatcccgatactgtacgaaaggacgaaatatgttctcacgcatcacaataggaattatctttccatcattgctcataacaatagtaaactctttccctgcctcatcaaccgataagctgagataagcatatgtttgggcatatttcaaagcattcgtaaacaagttgctgagaatcttagtcaaagcttctttatccacagaagccaataattcttcctcgggaatctctaccttaagctcaattcctttctggttaaccaaagtggtaaaacgcttataaacagaacgaataatagaaccgacgctgcactctaccggatttaatttaaaccctttattttctgttttacggaaatcaagtaattgatttgtcagattcagtaatcgttctgcgttctggtccataatttctaattccatcttcacattttcaggaagtgccttctcggtaagtacactttctaaaggacttttgatcagcgtcagaggggttcggatctcatgtgccacattcgtaaagaactctatcttagaagtataaagttcccgttctttttcctgctcaaacttctccatcgctctctggtgcttttcgactgcccgctttctaaagtagaagaaagtagcgaaaagtgctccaagtattaatattacatagatgatataagcccatacagacaaataaaacggaggtagaatccggatctttaaagtacgcacatccggattccagattccatcactatttgcagcctttacctttagcacatacgtcccatagggtaaattagaatatgtaatcagatttttacctaccgaataccattctgaatcatatccttcgagcttatataatactgtattcatgtcaggtgactgataactaagagctgctacactgaaagaaaaagagttctgattcgattgaagctcaaggtagtcggataatgtaatactttgctttaacggagagtccgtactaccaaccggaacctttttattaaagagcataaaatctgttattaccacaggagggagaaaatcattgtcaacaaaaacagacggttcgaaagaaataaaaccattaatactaccaaagtatatccgtccattcttgtccttgtaactggactgataattaaattgattactcagtaacccattagcaatcgtatacaccttaaattctaaagttttcggattaaaatgtaccagccctttattggttgtaatccaaaacaaccctttttcatcttcctcaattcgatgtacgacattactcggcaatccaatactcgaatcataacgcacaaatatcttaccagaaggatcaaagcgacaaaagcctcctccctgtgttgtaaaccaaagctgattctggctatcttcaaatatactcagtactttgttagaaggcaggcttgaaggattcgtttcatcatgcatataatgttcccactcaccagtacgtacatttctcttatatacaccatctatgtaagttgccagccatagattcccctgtttatcctccttgatattatatataaatacccaaccaagttcaggtacacgttcaaaacggtttgtttcagaatgataacggaataatccggctgttgttccaagccatagattacctgaagtagtccgacaaatagagaagatatcattgggagcatcaaaataatgctttacagcgtgggttcttaagtcaatccgatttagccctttggcaaaatgtccgacccataaataattcccatccacacataatccatgtacattatgataaatgtccggatgcctgaatggttcgatcagccctgtagaaggataataatgaaaaagccccttatcttcggtaccgatccagagagtaccatcatgatcggcacaaaactcccgcacccgtttccccatttcatcaatttctgtccggggatagactttatcaaaataagtatattgcttaggatagtagttcacaccgccaaaataagatccaatccatatccccccttcacgatctttacaaatcgaataaatggcattatcggaaatagaatacggatcaccgctcacattccgtaaatgaacagttttctttgtacgtaaattataaatataaagcccagattccgttccggcccataactcatcatccgaatagaatgctatctcccgaacataaatatcatctccggattcatctttggataaaagagtacgcacagtcttattggtcagattcacttctttcaaccccgttatggtcccgacatacatacaattataaggaccgggaagcagtttgcatatatattctcctttgaaaggttcatttccatctttaggaaataccgggaccaaggtttggagtttatcctttgaaaaatacaagttgccatcacgtatatccagccaacatacattatccgaatcaaagtaaagttgcccaagactaccaaatttcaacctgccggattgatctgacagataatttatcagcttattagtctgaggattataataaaaaaccgcctgagattgtgtcaccacccaaattcctccgtccttatctcccgtcaccagattgaccgtataatcgatccctgtatctaaatcacttttcattataaaacgttccacagtctcgtgctcaggcgaatatacatagagtcctacatctgttcctatccagatttgtccttgctgatcttcgtacaaggaggtaatgaagttattccccaaagtgccggactctttcataaaagcccgaaaggaaatgccatcatatcggtctaatccatccttcgttccaaaccacataaaaccctgtttatcctgaagaatggcgtgaaccgtattttgagataagccattatttatatccagtgaacgaaaagcataaccctcattcaaatcggcaaatacataaaaagtatgaaagataaaaacaatcaatataaaaagactgtgcaatattctcataacgtgctcctcatcttattaaaaaagtattatatacaacaaagttaatctaatatatcaaataacagatgccattgtcactaaatcaagtgagcagaacacccttccatcattggtactattatacaataagcaaacatcaaagagaaaccggtgaaagataatagtttattgaatatgatgcgctattcgacttattagtttgttataagacaaaagtagcaaacatggaatatttggtgtatcaaaaattgttcaaaagttaacagattctatgcaaatacatggaaatacatagctaaaacaacgatacagtagtataaaacaatagaggaaccgtattcgatccctctatcagtttgaataaaataaatatcttatgcaatccactcaatacgtatggaaagattgacaagcaaacataagcattccggcaaggataaataactgtcgtaacaatgcctaatatacctgacttcagacactaatgcctgcgttatcagacattaataactgatttctcaactgttaaaacctgatatgccaactattaatacctgacgtatcaatcattaatacctgaagtctcctacttttcgaacaatatttgctcagaaaaaataaaaataaccgcttactttataactttcggtttaataacctttccggtaatagaaacgacaccttgtttagatatggtaaagtctttaaagtatgaagtacgcgggtgtattttctctttattccaatgagcatgaaaaatatatttccaactgccgtctttgcattggaaaggagcaccatgcccagtacctaccagtccggtaggctcatccccttgcaagagcggattcttgtcatacttagtccatggacctattggcgacttggaggtggcatatcctactccatagcctttattctgatagtgattggcagagtaaatcaaataatacatacccttctttttcagcaccgagggcccttccgccactttagcctgcaatagttcccacggttcttccgcttttatacattccgataaagtctcctttttaatcttcattaaatcatcggtcatctgagctacccagataacatttccatccgtgaaacgtacaaaatagaggtatggagtaccatcgtcatcaatgaaaagagaggtatctatactcttctcctcccagataggttgcttcgactcttgccgaaagggtcctaccggagaatctgaggtagccacacagatatgttcttctacagaataaaacatataaaatttcttctttgattgaatataataaacctccggcgcccaaaatccccatttaccatatgaatcatctgcagaaagcgcctgcccctcacgtttccagtttttcagatcatcagaagaaaaacaggcaaatccctcgctcactgtacctccggtgccataagcatagtacttattgttgtaaagcatcacaaacggatcagcaataggcaagtagtccgtttccgtacttttgttttcaaacggagcattgttatcacctttatccactgtactgctatttacatttcctccaagaagcaggcagaagaacagtagaatatagaatcgtttctttagcatatatatcatttctaaatatacagattagatgaattacttaaccaacatcttttcggcacgtcccggagtcaatagctcccacaaagaggccaccgtccatcccggtgcaaagatatcgttataatatcctttcccgttccttccataatcccagttcgtatgttgaacaacttccggataataacctactttggcaatgccgcacatatggccatcgtgaggcaataactgccgcatagatgtagaaatcacttccgcaaagtctgcaaaacgaggttctttatattctttagacaaccactgaagcacggaagcaaactcaaagataaacacatcgatatggttattctctacggacacattaccccatccacgtgtcttcagtcctatatcacccaacatttgaccgggagcaaaaggtacatcccacaaataataccatgacaacgcaaaatatgctgcttttttcgtcaggtcggcataatgtttatgctcttctcctttggttatcaatgccaaatagtaagtagcagttgcagcataaagcgatgcttccttatcttcacagtttgcatcaagtgtagaggagaaataatctgctttcgaaatcagttcattttccagataatccgctgtcttcttggcactatccagatagcgtttatctttaaaatacttatatcccatcactaatggcagagtagccgaaggagtactaccaccgctcttatcgactatagaaaaatcatcccggaacttacgaggaaaactaccgtcctgattctgcaattgcataaacatgtcaagcatcttcttcatccgttgttcccactccgaatggcgacgtccttgttctttctcgtatgccaggaaatgaagcattgcatagattccttctgattgacggcgaatactatgaaccggttcctcaaagttacgatccagattcacaaattccttaaagaatcctgcctcagtaaaaccattcttcaagtaactgtcaaaaactttaaggctgttttccttcagttctgcccgatcgctttcccagccatattcccaagcattgaatgcattcaaaagaacacgtccgacaaaacctacttccgcctctccattacttttacagtcatctgtccgcaagcctacccctgaatagtaagtcaactccggtttactcaccaagctattcacgaaaaaagaactaagagtatttttcatgtccgctattgaataaggagtatcaacaggctttggagcataagtatcgtaacaatattcccaagtatgacgaataaaatccgagtaatcttcggctgcatcttcaaaaatagtccagttcaataaaacggtttcaccttttttcaacaactgaaaagcctttacctgcggggccaatgtcagcttgcgaatatagctcttaggagcttcctgataggggaaaccgaaagaaagtgtagctatgccattacgattctcaaagccggtgaaaccaagggaggttttaccggaaagaataacctctccctcccgatgagtagtcaaagcgtcattctcgaactgatcgatacggtttacggtcataaaacgtttggttccctcactgtagatacctgtaagaggggtacttaacctatcttcacgcaccaaccaactatccgaagtatgaaatgagggagccgactttggagaacgaagattacggcgataccagaatccgggcatgtagaactggcagtcatcatggcggaaccctgttgacacttgttgactgtaattaaaatatacatcctccaatgcagtgatacatactgttatctgcgattttccgcctttttcttctattgtttgataaactgtcaacggaattctttcagaggcttccaactgataagcgcttttgtcgtttttggtcttctggaaagtcaacgggtactgttttgcctcatttcccggcactttcaaagaaatagatgcggatacacgttccgacacattgtcaatagcctttacggttccgacacataccaaaatagctattccacaaagtaagcattttaaattcatataaatcaaattatgcgaatcagtagcaatcaatctccgattctgttagtattaaattttgttgttatcttaattctgtctgttctacaaaataaaatctttgatgacgaaggcaaagttagcaaacatcagctgttcagaatgccacaaattgaccgataaaagaaaaattctgttcaaactgcctaaaaaaacaactaattatattggaataatacctattttaatctctcctgtcaatatctaaaaagaaatcgttttaaaaatgaggtttgggggattctgtagaagcagaactacttttcacaacaggccacccttttttccaatcaactctatctaacaataaaactctcccatagggattggaaacactcactccatgatataaaatccaatcattatctgctttatcggttattagttccgcattatgtcctgtgcctacaaagcttttgttgttatgaatcaataccacatggttattatcgagcatagaccttccctgtttatccaaataaggtccccacaatgaactagaacgccctactactgtctgatacgtacttttcaatccttcacaacaagttccggtagaagcaaacagatagtaatatccattctttttatgaatataagtcccctcataagcggttcctgctatctgtttcttgtctgctccagattttacttttagcccgtcggctgttaactctattccatatatgccgcgaaaactcccccaaaacatatatttccgccctccatcttctatataaaatggatcaatcgaattctgaaccccaatttcattacttctaaacatcattccatgatctacgaaagggccttccggtttgtcggcagtagctacgcctattccacaagtccactcacctccccagcaagacatcgaataatagagtacatatttgtctcctattttattaatgtcaggtgcccataaattcccttttggctcaaaagtcggacgtgtttcatcggtaaaagctgtaccgacagactcccatttgatcaagtctttagaacggtgaatcggtaaattcctgatatcttccgttgcatacaaataaaagtatccatcctctgccctgatcacactgggatcgggcaaactataattaacaaccgggttcttataagtcttagcgggatcttctgccataagcgtaaaacttatggtaaggagaatttctattaacaacagttttttcatctctatattgttttaatctgacacatctatatagtaaaagcgtgaaatatgtggtaatattccacgctttacttaatctatttactcatttacagaaataatatctaatataatgacatccaatatcctgcaatcttatttatacagtaccttattacggtcacaaataagttttccatccttaaactccaattccgccatctgcaagaaactcagtttctggtaaacatcatcaccagcctcgtgtgtatttggattatatcctaaaaagggttgcacatggtatacaatgaatgcccgatcatttctgataatgacactaggatgccgggcgcgagtattgtcaaagaaccgagtacccggttcatacatgacaattccttgatattcccagttctccgcatctttcgaacgatacacggccaatcctttatgaggatcagctattatccagaaataacctttccactgaaaagcataagccccctcctgatatgtatgcttcgtcacctcgacattattaatatcgcctttggcaagcccctttaatgtccaatgatacaaatcattactttgtgcataatacaatccgcctgtatcttctgtcggacggtcacgataccacatatcccaacgatcaccattctttacaacagtcgcatcaatagaaatcggagtatccaccactgtatttacccgtctccaccctgaaatcatatcttccaaaggtgcagagaaatgaacaatgttactaggtccaccccagaccggagtagagtcatctttcaaagtcacaaacatatgggcactatcaccttccacaatcacacccggtgcccaatacgttttctcactatccggctgaccgcctacaccatcgaacgagcaatatcccgcaaacttccaatgtacaaaatctttggacacagcaacccccacaggcgttcctacataagaagcctgatctttaaaaggacgacgtgatgtataaaaaatcatccattcttctgttttaggattccaggttatctccggatcagccggaccatgatagtgattatctacataaatgggtgaaggaatgatcaccttaccatcagactgacaagaacaaagtccccatatcacccatactaaaataccagcaagtagatgtttcatttttattcacttttataaaatgtaaattccgagaactgtacatatccctgtccactccatgaatcgagaaccttaattcttatatagcgaacctccggaatacctgatggaaaatcaaacttttctccttttgctatataagaattgtcttcatccgtattctcgccaacaggcttgccagaaggcttgaaagaattacaagttatcagcttagtccatccatcccaagaagaatttgccggttcatcttctctaccccagatttcccagctcttcatatttcctccattataattcaaatcatcacgaacaaccgaaaacaagtcaaaacgctttaaaagagctttctctcctaaatcgaaagtaaaccaagcaggaaaaacgatcggattcgtattatcactatgtgcatagtttgtattttcgtatgcattatcccatgctttccataatgctcctccccaagcgttcaatcggatatcattatccagtattatttcacggaatgtacttttatccatttcaactattttttctgggaatacccccgttgaagaaacagagaaagtatctactgcattcacctccggaatataatatgttttgacttcataggctccccgcggcttccaatcagtaatcttaatctgattatctcctcttgccacctcttgttcctgcttctcgccggcactattcagataaaacactttagttgccaatgcttcggccatttctgaggaaaaatttagtaacagattttccccttcaacctctgtactcaacaaagaacgtacccgtaaagaacttatgtaccgatcaccataagttttacttccttttgaggttgaaatagaacgatacccacttttgttataggtaacaatctcaaattgataagtaccttcaggtaaattctctataaaaacacgaaaagtatctaccggatctatccgtttaacaggcactactaaagagtcattgtccggtgtccaatgaataacgcacctttctgtatccataccatatttaagtaatcccgttacttctacccgattatatccaggacgtatgtcaacagaatccatttttgccgcatagatagtttcaccggcatccagatactcttggatcgtgtccaactgaccggagcaagctccggcagtcaatacaacactaagtattaatcctatcttatataaatatttcatattcagctcttttaattgttagatattacattgccccagaaagtaaattctgtaaagtgtataaagtccatacctccccatgtttcaagaaccttgaaacgaatatatctcactggaggagcttctgccggaaattcgaaatcctcacctgcttgcaaatattcccagtcttctgctgtatgctgcccaacaggtagtcctgacggtttatgagactcacaatccatcaatttagtccatccatcccaacttccgtcagcaggaggcgtatctgttctcccccaaacttcccaagtctttagattaccacgctggaaagcatgttcctccataaaaagatgatagaatttatacctgctcagtttcgcagtgactcccatatcaaaagtaaaccacatcgggaatgtatctccacccggactatgtacaaaaagagcaggagtataatcgtcattccatgcataagctaagtttcctccccacgcattacatgctacatcattcggcaatatgtatggatagaaaagttttttatttaatcgggtttcctcgtaaggagttaaaacattatataaagtatccgaactattcccccaacggtcaactacataaatatcaaacatcctttcttctgctttaaatccacgaacataaaaaggtcctttctctgcctgtgtatattgtacatgagcttcataaggctgatttaacgaatcagtagttacaacatgaatagaaagactcgctttttctggatttttgaaatttacatataccccaccaaatgtagcattcacttccaaagattcgaaggtagtcagaacagaaggcttcaatggagttactactgcaacagtcgtagccccctcattttccatccggtccacacaagacaattcaacttcatgttcattcatatctccaaatccattgacagtcaattcatttgcatagactgaggctctagcctccatttctttcccctgaccaactttatagcgggctctcacatacatgatatccggattatctggtagttgataagatataaccgctccacccggaatatttttcactttaatctctgatactacaccaggagcaccagcttccacatctttcccaaagggtcttatgttatcgtcttctttgcatccgattgataagaatatcaagacaagatgcaataccattatatatgatttcataatattcatttttaccaaccaggattttgaactaatttaggattcacaatgcagtcataatcttttaagggccaaagattttcacgatcttcatagttacgaataaaataagtattcagcttataatattcgtttgtttcagattgattaatatcccatccttgcaaagacttattaaagtattgattagccagattccagcgtcttatatcccaaaaacgctgcccttccaacgccaactcaatcattctttccttgcgcacaattgtctgaaagccttcataagtattgggtttattggcatcattcgcatataaacgccatgaatcttttactccctttagcccggctcttgctctcactttgtcaatgtaagtatagcaatcctcaggcactgtgccttcttctttcttagcctcattcaaagcttcagcatacaacagatataaatctgccaaccgtattatcgggaaaggatatgtctctatctgtatgcttgcaggaaccatcgcattctgataacgtaccagcttctttgcaaaatatccagtgattgaatacaaagtatttccacgctttcctgaagcctgtttggcttttgcctgaagataccacatatcattatcatccatcttaccaatgccataccaactggaaccatcgaaacctagtgttgcataaaaacgaggttctctatcaaagtgtagttttgcagtcgtataacccggttgaatataatacttatcggcttcagttgctacttgagtagtgtatcgcttactataatcataatttttgtcttcatccattggtacaccattcttagtataaaaagtttcagccacagccaaagtgggtgcaaatgttccatttcgggcattatgatatcggtcgtcagaagagtaattagactctaaccaaggctgacaaagtacctgcaaatctcttatacccgattgtccacatccccaaacaagttctttattccaacgctcggtaaccttgcaacgattacttaatgaaagaattgtttcatcactcaattgggtagaagacatatttacgaactcataaagtccatgtcccgcttcctccgcacattgaatggcctccaaacaggcatccgcagcttttgtccatttctcattatcatatacctgattaaagaatggttcaccttcggcatttttgaaatttgcataatccagattgccattaaaaaacgggctcgctgcaaatgctaatatcttagccttaatagccttagcagccggacgagttattcgtcccatttctgctgcttcgttctgaatattcaatggcaaatattcgactgactcatctatcagagaaacaatataagtcacaatatcatctatcttatcgcgaacgactctcacttcatcctcaccagccgaaaccgggatgttttcttttataattgggataggaccatacattctcatcatccaaaaatgatagaaggctttcaagaccttggcttctgccttccatgtttctttatcataagccgaaagatcaggaaccttctctatgttttctataaaaacattacaatcacgtatccctacaaacatggcttttccccattgtgtcccattccaataatcgaccaaaggttcattggaattttgcatgcctttggctatccaaaaagtcgttttatttgaatagtcggcagaattatcactataataccacacttcatcacctacatccatccccgggtcggttccaatcttaccatgttccggaacaaaagagtagcaagtgaacagaaatctttcagcagaactcttgttattaaaagccatctctaaagtcggcagattatctggaacaatatcaagataatcacatccagacaagaaacctaagagtagcaggaaattaaatatcttcttagttttcatattattattctttaaaagtcaacttgtatacctaaattaataacacgctgattgggatatccgactcctaatccacccatctccggatcccaaagtttaaatttactgaaggtcaataaattagttccattcgcatacaaacgcaatttagtcaaatgaatcttctttatcatttgttgcggaaagctataccctaactctaatgatttcaggcgcatgaaagaaccatcacgcatccaccaagtactcacttgagtattattctttatcgattcagtagaaagacgcggccagaatgcataaatatcacgatgttcttctgaccaatagctatcagctatcgcctgaaataatgctgtcttccgagtataagaacctgtcgttgacggaggattattgaatggtgctatctgctccgaatctataaagaaactagatcttgcagatccttggaagaaacaagatatgtcccaattcttaaatcccattgacaacccaaaaccatacgtaatctcaggcgttgtaggataaccgataggaactaagtcagcatcagatatctttccatctttatttatatccttatacttgatatcaccaggcaaatatgtcccaaaactttgtaccggagagtttgcaatatctgcctcatctacaaaaagtcgctctgcaatatatccccattgttggctcaaactgtaaccgactcttgacctccatggtaatccggcagcagcataatccggttcatcagccactttaaattcacttgtcgcataagtgaaattaccataaccctgcaaccaaatcttattattaaaccaatggttataattcaccgacaagtctactccatgagatgcagcttcacctacattagcacgtacactagcctccaatcccattgtagtaggaataaaacttctgtccattaggattttagaacggtcttcacggaaatagtcaaattgtacatccaaactattgaacaagcctagttcaaaaccaatattcagcttctttgcaacttcccatgttataaactcattgggataacgtaccgtggaaatcccatctttataatttccccagttggttccaaaaacctgtcctctaccggaagagttcatattcatattagacaagtagaaaaatcgatctgaatcacttcctattgcatcattaccgacaagaccataagtaacctttaacttcaacttatttgccactttctctatcggtctccaaaaagcctcattagagagcatccatgcacctcctatagaagggaaaaaaccatatctttcattctgagcgaatcgttcggatccattgtatccaaagttgaattctacaaaataacggctatcataaccataagacattcgaccagatattccctgatttcttttaggtaatgattttataacactaccggcattccccaagagttcttctttcctttgatataccaacaaagctcctacatcgtgcaaaccaaacttccggacataattggctttagcctgcatatatatttgggtatagacatctttcggcccttcactatagcccagatattctgtcccgctatcaggatttagtgcttgtaatacatagttatccgactctttatcataaaaaccaattttatagtaatacggagtataagagcgggaaacatcaaaataagaacgtctcactgtactaaaatgcccttgtacagttaacccctctgttataaagtccaaattctgctcaatttctgcttgtgcagaaatgttggtacgactataatccttatacccgctagtcataattgcataaggattgatatggttagctccctccatgttaccgaaaagcggatgtcctaccccttgattttgtaaatcaggcaaataatatttaggaaaatcaaccggacttgcgtgtatagcatgatcgaataagatattacctccgtcaacaggaccacgataatcatcaaaatcagcctgaaaacgcaccttcacttctgttgtctttgtcagatgaatattaaaagttgataagatattgtacttcttcaggctaatgttcgaattaaagttattcaatccatcattcttaagtaatcctgtgtcattactaaatgtgcccgccagataataagttgccacactaccaccacctcttacattgaagtttacccgctgattaacagtataatctttaaacatctctttcatccagtctacggtcgggtaaacatacggattcctattgggagccatagtattagcaattttagattccggataaggaatgaccccttgaggatcacgtgtcagaacggcttcattgtttaatctcatatatgaaataggatcagcaatatcaatcatcttcgtcggagctgaaaaggaattctccacacgaaccgacacctgagcttttccttcctttccttcttttgttgttaccaagataactccatttgcaccacgtgctccatataacgctgtagatgtcgcgtctttcaatactgagaaactagcaatgtcatcgggctgtactcgcgccaagtcatctgacgatacttccacattatcaagcaaaatcaatgggtcttttttataaccaaacgtcgttacaccacgtataaaaaaattagcattgtctttccctggttcaccactacgttgatacgctatcacacctgccatacgcccagccaaagaagtagtcagattactactgggtgttttcagctccgcaggttttacagtctgaatagaaccgattacactctcttttttttgcttagcaaaagctactactgtcacttcttccagctcatcccgtaattctttcatcacaatcttcatagacgcttttcctctaacaggaaccagttgagtctccaaacctataaaggttatttgcaaaacatcactctcgccaacttcgatcgtgaaattaccatctatatcagttatgacaccgccagctttcccttgtatctggacagtagcacctgttaccggtgctcctgcctcatccaatacattacctctaaatttctttgtcttattctgctgaatctctgttatactgtctgttgcataagaagaaactacaggaaaaggacaacaaagaccaactaacaggatacatgccctccaagagattgacaaccgtcctctctttgcaaagtttgtcatagtaaacataagttctcagatttaacgtttaacaaatcatttcccgtgcttttcgtgatttccttctttacctaaggcttcccctaaagcatcgagcataccataaccgaaacgattgtccggcaataaatagtgtccttcagaccattcattaaaacaagcaatggtcagaattcgtggaacttccggatgtttgttcaaatacacaaaagacgattgaacaaaagccttgaaagaggctggattctcattcttaaaaatagtgcaacccggccattgactacggtctgcttttgccggacgattcgccggagctatatatcttggagtagaatcccatcccggagctacagccggaacataaggaatatcaaactgaccatgatgttcatcccataacttaaaagccacatcagctgccactgttccataatccggcaattcgatttctttgggttggaagcgacctgcaatccaatccatcggattataagagcctacagtatcatatccctcttctttcatatttccacaactgaaacctgtcacatgaaaatgcaaacctttatgtcccagtttttttgcataatccgtcaactccgcaaataactgtttcactcctgctattcccaatttagattccaaacgccgtgcatcccaaatacaaatcaccggcttatcatcaattctccaataattctccaaatggcaatagcgtgaaatcatataagaaaggcttttccaacactcttctttagagaaatcgggagcatcaaaacttggaggataagcattacttccatcagtacgcttcgttggatacaatacataccaaggatgattggtccacatacaagcaaactttacgtcttttgtattactagcttccagaaaaccattttccaatgcttcatgcagacatggtttaccatcataccaataccaatcccaaatcaaaacatcaatgccactttgtttgcaaagcttgttatatgtctcccaagtagaaggcttactctcatcaagctcccctaacaagggcgtacgtggctgttgatgcccttcaaaccaaggacgagcgctacgaatcaaattatattcagtccagccctgagaatatattttattatgcaaagccgaagcatgataattaggaaaagcataagcagccaccgttaatccttccggtttctttaacaaagcaggatcacctgccaatgtttcaagatcatcaggcaaacgataaatcttctctttactttttttctgtgcataaacaggcaatacacctattatcaacaataaaaacaataactgactaatacatttaacaaactggtttttcattttctttcttatttaaagttcaacaaattcaatattaaaaaaatccatgtatctgatggttatcagactttcccacggcttcagcaagcgcatcaagcattccatatccaaatcggttatccggcaataagtaatgcccttcagtccattcattaaaacaggcaatagtgaggatcggaggaacatccttatgcttattcaaatacgcaaaagccgactgaacaagtgctttgaaagatgcaggattttcattatccaaaataacgcaattaggccatgcatcgcgattgggttgatccggtctgctcaccggcggaatatatctgggagtagagtcccaccctggcgaaagagatggaagatacggtatggcaaagtcatcatgatgtttaggccataatttgaaagccacatcagcagcagccactccataatccggcagttcgatattcttgggctggtaattatcagctacccaagtaaacggattgtaagaaccggcagtattataaccaacctctttcgaattaggagaataaaaacctgaagaatggaaatgtaaccctttatgtcccaacttacgggcaaattccgttaattcagcaaacaactgtttaaccccgtcaaccccaatattcttctccaaacgattagggtcccaaatacataccacaggcttgtcatcaatcctccaataattttccaaatgacaatatctggaaatgatataggacaaactctgccagcactctttcaagctaccatctgccggtgcaaaacttggaggataagctttatatccattgggtaataaagttggatacaatacataccaagggtggttggtccacatacaggcaaacttcacatcattacggtttgaagctctcaaaaagccattctcaagagcttcatgcaaacatggctcattattataccagtaccaatcccaaatcagcacatcaataccactctgcttgcacagctcattatatttttcccaagtacccggcttactttcatccatctccccaagcaagggacctctaggctgagcatgcccctggaaccaaggacgggcgcttctcaccaaattatattccgtccaacccggcccataaatcttatcatgcaatgcagaagcatgataattcggaaaagtatagcaggcaactgtcaggttatcaggttttctcaacaaagaactatcttttacaagctcttgtaaatcttccggtaaccgtttcgcttttggagcattccgctttcctgacgcaacatcagaagcccctatgctctccgctgcatgaagcatttcagtacccacagcagaagctgtaacaatggcagtacctttcatactcgcagatttaagaaaagttcttctatccataatattatagtatttagttatcacttaaaaatttagttattatcttattgttgattattcaactactttccccgatacgacaaatctgtcaacctctatatgaccggatactacttttacaaaaggttttccggaacgaagttctatattaccaaatccagactccgtactgataaagctaataaagtctcctatttttgaattaatatacagtgttttatctacagcatcatatcggactcctgtcaatccttgaagtaagccataactggataacgctcgtccgtaccaatgtccacactcatactcattaaaagggttacggacgcttccatcataacgttgcctacaggcacgtacgatctcaaggcctttttctacttctccctgtagcatcaaatgtgaagctacttgatattctattcctgtccagacttcattactatagacaaaaggtaatgacaacttgccccctttaggccaacttcctaataataagcctccttctttgcctaaagcgtaaggggaacgttgaggattggcgtgatcagtcagatctttcttaaaattatatcgatgtactgataataaatggctcttcactttttctgtattcagagtttcttccatcccacacattcgggagagccacgaccccaaaactccatcagacagacaaccgttcccatactgatacttaggaccttccttctccagtatttctttcgcttcgggagaataagaactatggaaactttgtgcaacagtcggatcttttgcattcaatcccctccactctatcttttggataaaatactcaccattaaacaagcctgtttcagtaaattttcgtccttttttcaatagtttcttatattcagtaacgtctttatcgagaaactcactcatacgaatgaaagctgataaagctccataatagaaactattatgcataccatccggcccccagaactcaatatcataagtattatggtgtggttcttcaatacttcctaccctacgaggatcccaagttgagatacagtagtccaaactcttttttacttttggatacatagagataaggaactcattttcacctgaaattctccactcacgatatactttcattatacctcccaattgcccgtcagcagctgagtgaaaattgtgccgggtaggacgaatcggtaaattgacacgaaacacttgatggcctttcaaatcttgcccttcttcaaattctgtatgccttaacgaacgttccaaagaaggaaataagtgtggaatagcctgtgcataattccagacgtgagtacatgagccatgacacgatccccaattatcggcacatccctcccaagtccataagcgtccgtcatattgccgcatcaccgttggagactttaaaatacttaagttagcagaaacagcttcaatcacttcaggcggtaaggtagaacgataaaaagagtctgtgaacctttctgtctgattgcgcaaaatcttataatgagacagaaaataatcaataacctcatttactcctgtaaagcggctactataccaaggtttataattacccttatctgccttttctacagctagtcttgcggagtcaacattattgtcattccagtcttccggttcctctccaagcctcaaagtcgagttaggaacataccatgccgtataaatcctgattgttttcttttcccctggcatcaatgttaccgggacaaacatagaagctcctggtgcacctttctctattgctggacattgtggcattaaacctgcctcaatagcgttccagaccatcgtaagactatcaaaccatcctccacgaaaccaacaataattaatctttaaagaatcctgatccgtaaagatagcaaaatcaccctgcaaatgaggctccgtttctgtacctgactgtgaaaggataaacccatgaggcatcgtttttatagcatccaatcctttaccccaactcagaaagttacgagcatggtaggagaaaatagtttcctgaacctctttactagtattctctaaactatattccaatcctcctaccggtaaactggaattatccggatcacccggaataaaaggactccaccccaaaatggttaccttaacgggaatatctttatctgttaatgaaaccttggcaaacggaaaacgtgcttcaaattcgactgtatcaaaacggggaagtcctaatattgatcccatactacctcctgttccgtaattgggcattccaaattttctccaatcagatacaggtccttcaagtaccttagccccattacatacccccttcacatacagagcagcaaacattcccggttcatgaaaaacttccggtcgatgccatactgacatatgagatatatagcctgttccttccagacaatacatacctgtaccaattccccctataggaaaagcgattcgattattatatttcccactataagaactattgtatatacggttcctttcgtcatcgatgtcatttgccgacacccatctattggaaatagccagaatcgaaatcataaacaaaagagaatacttcaacttttccataaaaagagttttaaagcattattcaactactattattggaatatccagaagaaatgccagtttcttcagttcagagactttatgtccaatgccaatcgcacaatgatgtgaaggtcccgctttactccattgatccataaaccgacgagcaccacacggaaagcgataacgactatttgtattgccaatatgtagagtttctccttgtacagcctctccctcagcagcaagtagaaagactccgtctcttccctcacataccgacaaaagtgtaacatcacctggtttaacactcatctggatggacagacctttacccggtttaccgtgatataatggaagaggcactagtttcactttctcttcggcgattgcaaaatgtgccgggccatcatgtcctagtaatacaatatcatccttaaaatccattgcataaaattcagagaaagaaccaccagcttttaatagtgacataattttcatcgcctgtgcatttttcacttcacattctccggcaacgggtattccatatcctgtcaacaacgtattacctgcaataacagaagttacaatattctcataatcattcccacagaatccttcgtaataataagccatcgctcccagttgatgcacattcactaatttatccaaagccacagaagtacgtgcagccctcactagctcttccgaactacatgatgcttccacattaaacttatcataaaattcgtccagttttcgcttcagttccccatcgctaacttcttctctataagcttttagctcacacatctccagcaactctatatgagtaccaaacactgcgctctgcttcataagatcagtatatacatctagcataccacaatagtaatgccccaaaactcccaaacggcttgtgcgcattccatacattacacgtacagcgtcaacccaagaggctatttcctcccaaacataatcttctgataaatagccggtgataatatcatatcgcacaccggctctattcaaaacactcgcaaactccggaacagaacatgcctgacaatgtgccaaccattcacctgtcattcttcctctatcccccattgaattgagtttttgataatctattgctgatgcaggctgtatatttaatataataataggcttgcctacttgttgagctacaggtagtatcgtagaagaaagagcataagtagaaataaacagaaaaaccaattctacatcagcttgttttaattgtaggacacattcattagcttttagaggcgaatccaccatccccgtattgataacttgtacgtccattgcctctattttggcagctatttcatcctgataagttaacagacggggaagaagcccttcaaattgtccccaataagtatccaatccgactcctaaaagtcccactcttactttttgttgtatcatagcattattcattttttaattatgatacaaacttagtcatcttaaaagagaaagactttcgataattgccagaacactatcattatttgatacgaaattcttctcgatattctataggtgattttcctgtttgtttcttgaaccgggcagagaaataagccggggattcaaaatcgagcctatatgctatctcttttaccggaatagtagtagtagtcaacaactctatggctttctgtattttcagattctggaaatattgcacaggtgcataattcttctgttccttaaacaactttcgaaaaagagaatatcccatacctgcttttttggcaatctcttgcatagaaactggttgatctatcaattccttcatgagcacacaagcataatctattttagaagagaaatcatcattctctacctgaaggttcttatcgatactacacattagtgctaccagataggtcaccaatccactcaatacgcgttgatataaagtaggttcttcgttagcaacatcaatagcttttctgaataaagaaacgatctcatcattgataccgaccttaaatacaggactttctttcgaacaatactcattcgtcatccagctatcaacttccggaccgcaaaagccgatccaataatgactccaacctgtttgataattaggataataggtgtgccattcgcccggaaaaagaacaaaaatcatacctcgcttgatagtaaacactcccccacttcttgtttcaagcactccttctccctctgtaatataaatcagttgatactccgtcagtatacgtcctttatccggattaaaataataaccggcagaatgattcaaagtcggataagaagtatttgggggaatttcttcaaagccgactgaagaaatgttccggtctggtcccaaactattattattcacgaaatatttaatggacatgcgttccatagcaactagtatttagaaaaagtagggcggaaagttatcaagaaaatcctaaaactgcaagaaagaaagaaaaaacatggtttcccaatacttctttttcatagtagatctcttccaatagcattcttccactcctacgccatgtccttctattgtaagataacatataaagatacacactctttctttatatcagagtcatattaatctatataaatagatatccccacatgtacgactcggtaataccaagatgtacaactgggtaatacccacatgtactactgagtattaccgagatgtacggctgaaacgtattatttatatatgttattgcatttatgttagtagcttataggccaatacactgcataacgttcaaaatgtactttataaaacggttctacaactacattatcaaattccttcaaatctattttaaattttaatgtatctgtagaaattgatttcacataagcaggaatctgcttaagtggcatcctaaataccggaatcttgttcaaatcgatcttattcattgccgtattgttcatctttccccaaaaagtagtaggcaaattctcagttcccatgcgcccggcaagtacgtatggaccatatagtaatgcagcataacggtcagaacccatcaaactttcgacatatacatgcatcggaagttgcaatatgattttattctttcgtgcccaagttctgttaaccacccaatatccatccttatcaaggataggatattctacttttccattaataatgaaagttactttatccgcccaatccggtttacgaatacgaagtatcaattcttgctttttctttaaattcagcataaagctcacttgctccgattcagggagtcggttttgctgaataagttctattcctttttctttccagaaaagaatagaaggtataaacaaattgactctaatatcaggatctccatcaataattctctttgaatgactataaataaacttgctaagttttgccggactctccagaccagtatgtccacagcaccaaaaagaactgtcacgtgaagcataaattctataatgccccggacgcatagaggtgaaatagcaacacatgcccttttctggatcgtaggctgacaaaatatgattaaacaatacccgctcataataacttgctttggctgcatcaggatactgacagaaaagagattcagtcaaacgtagcatattcactgagttacaagtttccggacctcctaccaaaagtacccgatcagcgaactcctctttcggaaaaaaatgttccccagtactgtttccccctattacccatgtatgattctgagttacaatattccaaaaattagttgctgctgtcaggaaacgttcatcacccgtaaactgataatacttatgaaatcctgtaaactttggaatctgcgtgttagcatgccatccaaaaagaatatccttcccctcagacagaggaccccacatcgcatggtcgttcaaccgacgcgcccaatcaagaaaacgcttctctccggttagttcataagcctccacataagattcattgatagagccatgttcgcagataagcaaccgctgaatctgatcatctgtcagtttgtccaacacttgatatccaaaccaatcagccaatcggattaatataggtaatgcctcttccatttgacattgcgtataggcagcagaaagcccaagaagcattttattaatcagataaaccggagcccatgcaccgtttactgtaggattatttgtttttatctttccagaagcaacttcagcaaatagctttctaccatctttgagccctagtaagaaaccatccttccctgctttttggcatagttcaagctctttcagtacatactttaaacgttttaataaccttttatcatcggttgactgatacatcatagatacagaagaaagatagaatcctaagaaacctccgcgcaaaggtccggcaccccatacatcttgtgattcccaacctgcatagggtgcagcttttgaaggtaatcctgcctctattcgataaaaatgcaataatgaatcaggattcaaccatagaagatattcctttccttttcgttgtaaatcaagaaaaggactgtccagcaaacgtacttctcttaatggaaaataagattcaaaagtgacatctgcaggtttactccctccatatgacgcagatacaacaggctcaaatgatccaataagcaataataagctcaaaagaacttttatagatgtctttgtcaatacacctttgcgcataaatatatcaattattttaattctatcttctttgcaaaaactaatcggacagggcctatcaaacccgattccagcaaaggtgaatctttccgataatgtttccaggtagtgaatgctactcttccccctttcggcttattcacaccattcttataccaatccggtaattttttgatagcaccacgactcaatgcggcaataccatttataccacctccaagtacatattcattctcttccggtagttgttcatcaccaatcaaacgattagtccactgattggttacttttatttccaatgtatttttgcccggctttaatacatcagtaacatcaatcgaatacggacgagcccacaaaatccctttattcactccattgacaatcacttctgccatcacctctaccgctcccaaatcaagaaagacaactttttcatcagacaatatagaagcctttataacaaagtccgtcatataggtagctgtacctgagaaatacttaactccttcgtcttcgtgtttatgcagagaaaatagtttaggcagagtaatcttctctggtgccccacaaccatcaggaaaagtaatctcccatttctgattgagcattacgggagttccaactttttcaacctttattttcttctttacaccatccgatgttataaaatcatagtttccatcatgccaagccagcagaaaacgattatctgcgtaaggcacccaattcaaggctcgttcatctgccttttttacatatccttcagctgccaaacgggaaatttccttgttcgataacactctctgaaataataccggaacagacatatctccattataataagaggctccttctttcaaagtagtaggattcaaccccggatgaattgtctgcagagatctcgttttataagttacatactcaccatttatataaatatgcggagcaccctctttatataccaagcaaatatggctccacccggaaatcggcttctctactgccatcttaaactcagggtatccttttgcattctcccacacagcaactccgtttctacctatagccattccacaagtagcatgtcctgtgccatatagcaattccccatgcgacggatagatagcataatattctgtccagggatatgatatatatcccattggattatccgtattcaacatagcatccgattccggttttacccataatgatatcgagaaatcatcttttacaccaaaatatttagcctgttcctgctcttcgacagaaacaactgaagcatccaccagacactcactatctttataaatagaacgaatagctgtctgttcaggaagatctgaacgaaatacaacaaaaacagaaccgtattcatccaactggataggaacagaggtcattccttcatttttctgatataccaaagcacgtgacctttcgcctgttagaggattccagaattccggaacttttccttctacacgaaagttacaaattatgtcttccggagtccgtctctgattagttacaaagtagacatccgtatctcctatttgtctatgaatataccgtatcggagcactattcggattatctccaacttcaaagtctggttttaactgaatctgcctgaatacctgattcaaattcaaagagatttcccaaaatactctaccttttccaatattacggtctatcattgtagccatattctttccccataattcatcacaaagctgttcgaattctttttcctctgtaatagaataagactgcaatcccacagtctgatgaggacgggcaccaacaataaccaagccctgctctaccatctcccgaagtttcctcaacaaacccaatgtaatatacgactgttcttgtagaacaagaatgcggtaactcatcccatccggaagtcttaaccgtccctgttctatccatgctctattcagcagggtttccgtattcatcagatcatagtcatatccttccggtggcaccgggttcaattcattacggtgtactttagtatagcccacaacattatcccccgtaaagtatgccagatcagcaacaaataagccttcttgcaagagagtttgacaacgattcagataatccatccaagcgcgcgccggttcccaccaagtgttcgtccggtcgaagtgtattccccaaggtcctaaagtcatagcaggaacagcatttgaatgaggctgcatcgcgtaacgatgaactaccatccggttaattccctctgtaaacgccttatcaccaacagccttcaatgcaaacggatattcctgccatcgccccgattccggttcagaagtatatgcctcggcacctactactttctgtccattgatatgggcaatagaagatgccaatttagcggtacgacgcatcatcaaattgttttggaaaatagcggatagcccattccaaaactctcccatcactccatccactcgcgaacctatctgtaattcttccatcggtccgcgatcataaggctcacaatacgataccaaaccatattgattacataaactcctgaactcaccataatagttatcagccagtaaatcagcctgtatacgacgaatatcccataaaaagcgttctgttatctctttacttcctacaattttaccagtcatagccggcaaatatctaatcaaatcgtatccggttctctcacagaattcatcctcaaatcccgatgtccagttctgcataccgacctcccaactatctatttccaaaccgatctgaatttgatgaacatatggtttgattaatggatataacaggtccatcatcttattaaaatgaagttgaatagcctgcttactaaatttatcacattcaagtcccacacctgtatccggagccgcacaattctttcttcccgtagaagtatgtcccatacgaatgatcgtccaatttcccgaaggtgcttcccaactcaaacatccgtttgaatcaacctgtttagttaaatcaatcacatcctccggatgaataacttgttctttatcatactcccgtatatcaatcagacctttatgattgaaaacactattatttagtaattgccaatcagaaaaacctattggctttccattcctaaaagaaggaaaagccaatatagcaacatctttataatatcctaactccatagcaggctgaggcaacaaagtatctatctgctctcctcccaccacttctatctcactccaagttaatttctgcattgaatattcaggagtaatccaaggtcctccactcgatgaccatcccggacaattatgcatcacataatcgatccccaaacgagcagcttcttttacggcatgtgcttttaactctgaccattccgaactcaaataagtaacagcccccttcggaatacctgtgcctccttctaaattaaagacacctcctactccgatacgatgcatagcctctaagtctttggtaataccttcctttgttatatttccattcatccagaaccaatatgtataaggacgggcagtcgaagaaagctcagtaaagtctttttcaagatcaaccattgatttagctttcactaaatgagtagtccccgaaggtaaaggtagtttctcgcctaccgagacaggtttaccgaaacaaggaacaccagatgcatcaaaagtgaacttctgtagacggatatcacgtttccaaccaggtgttttctctcttttcgaatgataacagatataatattccctatcatcaggtgaagttgtaaagctagcatgtccaactccaagcacttgattagttccctcaaatgccggcttctcactcttaatccaactctctgggtctaagaggtctgcatccgaatctttcagacgcaaataagatagtttatatgtatccagccacgactgaccacacgaataaacaataaatacatctttctcatgcttcaatatttgcggtccctcattcaatggcagttctccctgttcataataacgatccggtgaagatattttcactcttccggaggccatagtccagggatttagcattttggctatgtaaaggtgttgctgagttttgtcagttaattcattaccttcccaaccagaccagactgcatatagttgtcctttatgatccaacaaagtcatatcaatcgcccatcgattattttcccaatcccctagagcatcacctgtaaacagcattcctttatcaacatacttccccattgcatctgatgtaacggattccaacacacctgctttctgatgaatgaaaggaggaccactatatcctgcggcataatagatataccatttacctttccaaaaatgaagttcaggcgcccaaacacaagttgagttccattgtcctttctctggtaccttccatacacgcactggaggatttatcttatgaagatcacgcgaacgagatactcctataccacccgggaccccactacaataataataccatccttcatgctttatcacccagggatcagcacccgaagataggatcggatttgtataatcaccatcatgttcttgtccatagaccatcgtcgaacagataatcattattatccaaaaagataatctttgtatcatttaaaataagattttcaattcagcttttcttttaaaatatctcttttatagcgcactaaagcctcaacataataataatcggcataggttaatggtacatcaacttctgccttacctggattattacctacagaatgctttaggataaaattgcaatttgtgccaggctccgccaaatattccggcgaagaaagggttttcaactgtgtttctgcaacagagagacattgcttcgaaaaatccccttctgtatacagactgagttcaataaaagcagaagccatcaatgcaccagcagaggcatcgcgaagttcattaggtatattaggagcatcaaaatcccaatatggaatcttatcttcaggcaaacggggatgatttattatgaatttagcaacattgatggcatgccgcaaatacttctcctgccctgtttcacgatacatcatagtatagccatacaatgcccaaccttgcccacgcgcccaacatgactcatgtgcatatccctgacaagtattcttcttttccggtaaaccggaaatagtatcataagaaattacatgatatgagctataatctgatcggaaatgatatttcatcgtcacatccgcatgtgacttagctatttcctcaaatttaggatcatcagagttcttggaagcccacattaacatctccagattcatcaaattatcaataattaccggatactcccacaccttctgattccagtcccaagaacgaatgcaacccacctgtggacgaaaacgggtactcaacgattcagacccctgcaataatgtctttctataatcatcattacctgtcaagcgtaatccattaccaaagctacaatacaacataaatcccacatcatgattatcagtagtatatttctggttttctatccgttttgtatagttctcagcatacattttcaaagaatcattgccattcacctcgtacagataccataatacaccgggaaaaaagccacttgtccaccaattggattttgatgtcatcaacttaccatccttgccgattgtacgaggtagttttccttcttcattcaataaatcctcagccataagctttgactgtacagttgccgtttgtaaactgttattcacgagagtactcatttcgcttttcggagttgaacaactacaaactgtcaaaagcaaaagagatgcaatgatagatgaacttactttcatttatatattcttttaaattatttctataattgagatttccggatcttaatctgagcctcaagtttatctctttctctactcaaatatgggcaatgcaccttgttttcattctccgatgcatccaattggcgatcaaatatcatccgggctacaaccgaatctccttgcagccatatagtgctactatattgctccgaaacaatattatacccacctttccactgaataaaggcgtattgttttgtctttttcccactgtcttgcaaaataggcacaaaactctttccctgtaattggtccttaggcattggcactccacacaactcgcacaaagttggataaatatcgacaaattctacaattccttttgctttgccacctctacaatgaggaacacgaacaatcaacggagcacgagttgcatgattcattagattatgttttccccagaatccatgttcccctaaatgccaaccatggtcacctaatattaccactattgtgttctcagacagtcccaaacgatcaagttcgtcaagtatcagaccaatctgtgcatcaatataactcacacatgcataatagccatgcttagcttctcgctggaaagtctcatctttagttgtaacaaatttcccatacccacgaatttcaccggaagaagtaacctgtttaggtaaagctttcggtctataaggattttgggcgaggtgtatttcttctcgccgatataaatcccagtattttttgggagcattgaaaggcaaatgcggtttccaaaaaccgcatgcaagaaaaaacggtttttcctttttatgcaaacgccttaaatccgcaattgtcttttgcgccactctaccgtctatgtaagttgtatcagcaacatcagccgactcacagaaaggacctcgtaaagttttaggatgaacataacgggaagactcttcattctgccataattcccacttgttatattcagcccaatccttaccatatccatcaggatgcactctccatggagcttccgaccaactatcagcatgatccgttatattatgaaatacttttccattagaaacgacataatatccgttcttcttaaagcattccggaagtgaaagagcctccggacaatctttctccgcactggcatcaaacgcagtaaaacgattcgggtaacgaggatacattcctgtaaacagacttgccctggaagccccgcttacaggaatgttacaatatgcattctgaaagaccgtagcataccttgccaagctatccagacggggagtcacaatatcttctattccataacatcccaattcaggacgcatatcatcggcaataataagcaaaacattcatcttattattctgtccatggagatgaacagaagacgacaaaacaatcacacttacaaaacaaaaagattgagtgtatttcatagccacatcctccagaatactaaaactatatcatttaaagtttaccccttcgaaagagaatttatttttaacatcattcttatattccttcagatagggagaataagtttttactctgacttgctgtttcttcacgtctatatccacaatacgcaagaaaccggtttgccctctgttcgtccctttcactccatcttgaaaattggctaacatctgaaacactttattaccatgatcacctatactgactaaggtcccaacaccgctattcagtacatgcccactgaatacaaaaagaatattaggatatttactaaccaacttatcccacatttgctcaccgttattcaccgcattttcaccggtatctttgcctaaaccgtatttctgcggcagccaacgatcgccttctcccatacgtgtatcatccgagtacatatatgcatgcgtattgataatcaccttatgatgcggatgtttcttcacaatctcacctgcccagtcaagcacactagtacgaggtccaaattccaaacaaagaatcagccatttcaatccggcagccttgaaagtataccacacattatccattttcccttcttcaaatgcaccaccgaaatttctcgtcttactgtatttatcataaggaaaatatcgattgaagagttccgaatctcttttattcgaatttttacctaaatcgtgatttcccattacaaaagcataaggaacttggttgtccatagtattcaaagcggcagctgcaacctcccactccttatcgacattgtgatcagtcatgtccccctgttgcaaaacaaagtcaatactatctgcatgatctattgcccattgagtttgcgattttaaaatatcgggataaagccgtgaataagtttgtatatccggcaacaaaaccagtctgacctgtttttgtgttttacaacccgagaaaataaaaactgccgtagtcaataaagctatccatttcatttgatttttcatctgtttctactctttattcaactttctcagaagtttatttagttacatctactttcttttcaatacttccctaagatttaatcctagtttttaatagaaccgtccttctttatatctcggctcccactccatattttgactgaggaccattcttcaggtttggccgtccaaaactcatcatccgcttgcaaacctaaaggtagaaaaataaacgtacacagataattactgcctgtggatacatatctatcggctatctccggttgatgtccacagaatcccaagttcaaccatccgtctttatcaaatgttcccttaattaactgtcttttcatcaccttagtcaatgcacagcgtacctgtgctggtttgatatgttccggtaataatttcatccaggaaacttgagctaatacctgaaaagccccaaaacgatatcccatcgacctgcccaacacaggataagtaccttccggagagatcatcttttcttgttgatcggcataacggatcaatcgttgtaactgtacatcataaaaatcggctccttcaacttcatgcttcttcataactgacaatacatctatcaacataggctggatcacataactattataataatccagatggaagttgcgtccgtcaccataccagccatctcctttgtaccattctttatgtctttttaatgcataatgaatcgggttcaattcacattcacctgtaaattccaatagagcagcctcaattgtagcagaaaacatcaaccagttagattctgaggctttgattctacgggaagctttcagttctttgataattctctcctgagtcactttatccaacttcggccagatctgatccttcgaacgtaataacccctgtgcaaaaaaagccgcatctaccaatggttgtccaccaggtccatcaaaacgcatataatccgaagaatccggattcacagcattggatatagatttcaccaccaggtcagtatatttagcacggagttgtccttcttttgtgccatcaggaggtaagtttaaccaagcagaaatgccattaaaggaacgccctaaagcttccaaatgtgttacattctttctagtattgccattattcaatccatcaaaggtttcaacaggcatgttctttctcagagtattctgactcaagtttgtataaaaaggatcaatgattttaatcattgtcttcacccagtattcacggtccttgcccggttttgcctgagcaaaaccggtaaacaataactggaccaaatataataatattactactttacgcattctttctatcctctttatttaatttcaaattcatccgattcactatagaaataatcgatagcagtttcttccggcaaataaacagaacgataaataatacgatcgcctgcaaaatcatctatcttaatctgcgtctcgggtgctttcagaatcaccgttttatcccctccatcaatgctcgtataagtaatttcggaaccaaagaaagtcggttcaagcgaagctgcaaaagtaatggtcaacacatcgttttttaaaactgccgtctttacttttgtattaaacaacaacttctcataaacatcaccatatacagtacaaggaacttctgacataatagaagaattaccatgagtatcatatgtgcaaacttcaaatacatacgaaccttccgccaaatccttcactataacctgtgttagaccagccttatcagttaattgtaattcagtggacctcgttctgttttcccagaagattttagctgttttagcacgtggatcaagcaacttctgccactcaagcatagctcggttacgtccggcatacgctttcaacgaatccacttttcctatataaacaataggtccttcttcaataaactctttatatgttgcatccatgccatcacaagacgccaaagtacctataaataaaaatacaagagcaaaattcttaaatagtctcatagcattatttctttttacttattactaattatgctttgcaccgaagaatgttagttcgtgaagatgcatgtagcgtgtatttccccaagtgttattcgtcctgaaacgaatgtaacgaacagcaggagcattatccggaataataaaattctcaccattctttgcagcttcctgatcttcagctgttagagcatcattaacaccaccacctgaaggtttcactgattcatattctgatagcaatacccacgaatcatcaaagcttccatccggattcggattaatacttccccaaatttcaaaatgtttcggatgaccagccttgaacgtattgccatatttacccggataataacgtgaaaccatcacaaaacgacttaatttataattctctcccatatcaaaagtaaaccattgaggcattaccgttgtcgtcttagtctgaaagcaggggtctgcatctgttattccatcccaaagtcgtgtcatatcattcccttttgtgacctcattccatgaatggcattcataagagtcggtcggtaaagccatctttctgaacaaagacttatcacattgttcttcataaagaggagtttcagttacatacaatgtatccgaaaggtgcccccatctatccctgacaaatataccaaaatctgtagtaacagcatcaagaccacgtacataaaaatctccacctttagcttcagtataatgcatatatacctgtgtccaaataccctctgcttgtttttttataacgcccagtccaagtttcgctttttccggattatcaaaattcactctgataccgccaaatgtttcggcagaaaccaatgttccacgaactttctgataaggaggtgtatcaggattcactttcacgactaacggagaagacacaacctcaccataactaacagaataaagctcaatatcatattcccccttagtcgggaaaccttccactaccaaagaatctgtgtagaaagaagcattaactgtgcggaccatgttatcaaccttataactggccctaacatatttcagattctgatcatccggtaagtcataatagataattgccgcaccaggcagattctttaccgttgcgttcaacacctgtgccggaggcgttgtacttcctgccggttcattcaaatcagcattatcagcacaagcagctaaagccactcctatataaagcaaaccatatttatataatttcttcttcataacgtcttaaatttaaagtttaccacccataattctgtaccagatttttattcgaatataattctttatctaatatcggccagaaatagtttcttattctgaattcttgagcataaatcaattgttctgtatagtaatcctcatttgtactatattgagtattccatcctgtaataggcttattttgttcctgatatgccaacttccatcgacgcaaatcccagaacctctgagcttcaaaggctaactcaataccccgttcttgctggataatctcacgtctgccgtctactgtttcatatttcttgttattcgtgtatgtatcccaactctcttctactccttccaaacctgctctttctctgatcaagtcgacccaggtcagaacatctgttttagaagcaccactctcattcaaagcctcggcatacaacaagtataagtttcctaatctcatcactgggaatggataagtaatcttggtaaacccactagtctgtcctacaacacttttaaagtgaactagttttttaggccatataccagtttcattccatgagtttgatatctgattagcagcagactgtccttgcttacattgtacataaatcggcttcgtttcatccgttacaccctgaccgaaccaaactgcaccgtcaaatcctaaacttgcatagtagcgaacttctctgtcaaaattgatactggctgttgtatatccttcttttataaagtatttatcatcagatgttgcctttctcaattctaagcgatcatcatagttccaggttttatcttccgtgataggtactccattttttgtgtagaataaatcagctattttcagaggaacagccagattaccaccaacacttgcattcccttcttttcctggttccaaaccgcgtggaatcgcatgatcctgcaattgaccgataatactatttgaattagcccagataatttcctgattccatttctctgttacaatattacggatattcatttttgcccgtgtctgatcagatatagtgtactcaagagaagtatatttatataaatcatgtccctgagcctttaaaaattcaatagcttgtttacatgcttctgctgcatctatccaacgttgcttcttatcttgttccgatttgttaggattaaagatctcaatgccccttgaatcggtatatcctttataatccgcgtttccattaaataaaggactggcagcagttaccatcacctctgctcttatagccattgcaattccttgagtaattcgtcccagttcttccgcctcattcattatcttatctggtaaatggttgctgtcgataatttcagtcaatgtgttaatcacataatcaaaacattcatctattgtatttctaaagacctttacctcttcttcaccagcattcaccggaatattctggtccataataggaatcggaccatacatcctgatcaaccaataatgataataggctttcagaaaacgcacttcagccgcccaacgatccttttcagcctgtgtcatatcaggcaccttctggatattctctaaaaaaatattacagtcactgattccctgatataaagacttgttgttttgctgatcggctcccgtccagtaatcacaacgcggtcttgccgaactttgcatattatgtgaaatataccaggcatgcacgtgtgctgcactacggaaagactccgtaatatacaattcatcaccaccggcaatcgcaggatttgcctccaatagtccatgagctggaagatagtaataacaggtaaacagatatttctctgcttgcgctctcattgtaaatgcattatcgattgtggcgatatcatccggaacgatatccagaaatgaatcacaggaggataaaacgataatcaaacaattcaatattaataattgtaattttttcattttatatcagatttagaatgttaaatttagtccaacattatatactctctgcacagggtaacctaaaccggcacctgccatttcaggatcccaaagtttaaacttgctgaagcacaataagttgtttcctgtaacatagaatcgaagattcttaataccgactttattagttaccttttcaggaatcgtatatccgatttctaactgtttcagacgcaagaacgaaccatcacgcatgaaccatgtgctcgttttactattattttcaatagaagtcgggcttaatctcggccacacagcatacgcatctctattatcttccgaccaatgactatctgcaataaacttagcaagtgcattatggcctaccctatttcctacaactttcgtatcaactgtattaaaatacggagaaacattattatagtcaatccagaatgattctctggccaatccttggaagaatacagatatatcccaattcttatatccataagatgcaccaaaaccatatacaatttccggctctttcggatatccgataggtacttggtcgagatcagtaatctttccgtccttatttacgtcacgatatttaatatcacccgcaccatattctccgaattgtacaggagagttagccacttcgttatcgtctacaaacaaaccttctgcaatatatccccaagtttgattggtaggataaccgactttttgtttccaccatgctcccggatattcatagtcttcgtacaccatatattcgctagttgcataagtaaagtttcctctcaactgcaaccatgatttgtttgcaaaatatttattatagtccagtgataagtcaacgccacttcctttagcttcacctaagtttgcataaggctgcacccaaagtcccatagatgccggaatagaagcgcgttgctgcaaaatactcttacggcgttctgtatagtactcggctgtcacattcaagtcatcaaacagagtaaattcaagtgcaaagttggtcttagcagatttttcccatgtaatttcaggatcagaataacgtttcactgagataccatcacgatgataatcaaagttatatccgaaatttgctccatatttactatcattcatgttaatatcggacagatacaagaaacgcccacttccgatagcatcattaccgactataccataagaagctctcaacttcaatttggacacaacactcttaaacgggtcccaaaaagattcatttgaaacaacccatgccagaccagcagaagggaagaagccaaatcgtttacttttgtggaagcgttcagaaccattataaccaaagttgaactctgcaaaataacgattattatatgcataagtaaaacgaccggataaaccgacattgcgataaggcaaagatgcctgaagcgagcctgcatttggctgaagattatttctcaactgataaaccaacaatccgcctactccgtgttttccaaagtcacgattataattcaatgctgcttcaatatacatattagctgtaatgcttttacctcccggatcataaatcaaatactccgaaccttcatccggattgataatatcgatagcataatcaccagtcagataatcataattagtcatcttataataatacggattcagcttacgtgaaacatcataactggaaatacgggaagtattgaacaataagcgggctgataaaccttctgtcaagaatttcaagtcttgctttacttcaaactgtgcactcaggttagaacgtcctgattctttatatccccttaccatttctgcatatggattcagatactgtccattttcagcattaccaaacaaagtatgcttagtgtatgcatgagcctcatctttgggatatttggcaggaaacaataccgggttacttttcataatcagattatacatggcagaaccaccatacaatggaccattataatcatcaaatacaccacttaaacgtacaatcaattctgtagttttagtagcattaatattcacattagagcgaagagtataaactctctgtttaatgttattattaaaattgctattcttatcaacctccagaataccattatcctgactataggaagctgccacataataacgtgccacatcgccaccacctgtaatattcaagtttacacgctggttcatcgtaaagtccttcaataattcctttctccagtccgtagccggataaatcacagaaccggagccaggtacagtattgtctattttctcttcggagtacatcaacggcgctaacggattacgtgtcaaataggcctcattgtgcagacgcatataagtaacaggatctgccaagtcaatctcctgagttggagcagatattgagttctcaactctcaagcttaatcgcgccttacctttctgaccttctttcgtcttgaccaagataactccattcgcaccacgagcaccgtaaagcgctgtagcagtagcatctttcataatagaaaaactagcgatatcatcaggctgcaaacgagctaagtcagtagaagtcaattcaatgccatcaattaaaattaaagggtcctttttataaccgaaagtagtaacaccacgaacgaagaaagaagcatcatctacaccgggctcacctgttctttgataagaaatcacacctgcaatacgcccggcaagtgcattggtcaagttactcgacggtgttttcagttctgcaacttttaccgttgaaatagctccgataacgctttcctttttctgtgtaccgaaagccacaacctcaactccctccaacatctgggaatcttcatacaagattgcatttatcgttgtttcactccctactgttttggtcagtttcacataacctacataactaaattccagaatagcgcctttagaaacgttagccaatgtataattaccatccaaatcagtcacgactccggtagtcgatcccttcaccaatacagatgcaccaataataggttctccatctgtacccaaaaccttacctttaatcgtcattcctttcttttgctgctgaatagtctgaatatcgtcagcagcatacacaacagatacagaaagaaaagaaaaagctgccagacatacgccggcgatccatagccgccttttcaggcatgcacttaaatctcttgtttttgttttcataattattaataaaaaggttatttcattttcaacatttcaataccagccatcaggaatgcacctacaccatacacttcggtcatgtctttagtgacttgttcaggagcagcgctgacgggctgaacatatccaagcatgccatcttcatggacatagctcttcaatgctttccatcccttttgagcagctttcttgtacttcttacctttcagtatcccctgattaattccccatcccaaaccatagacaaagaacccggaagcactgttttccggcgaaggatacgattcgggatcaagcatactcgcatgccaagaaccattcttatcctgacatttgatgacggatgaagccatctctttgtagatattcagataataattataagtcggatgctctttgggaagtgtttgtaataacaaaggcagtccggcaaatacccaaccattacccctcccccaaaacactttctcaccgttcttctcctttttcgggatgtaccttctgtcccggtagtacaatcctgcatcagcgtcatataaggaatctgtagcttctctaaactcacgatccataaaatccagatagtttttttcaggatacagtttgttcaactgtccatagacagggggagccataaataaagcatcacaccatgaccaacgctccgaccagttttttgcacctaaccataaacgagctttcgaaggcttagccactatcgaatctactcgtgcgatagtaggctgaatcattaccggatcatgatacttctcatacatacggatatacatctgtgctatcacaagatcatccgcatggtagagtcttttcaagaatccccaacgatgctttttccctatctgcatcagaaagtcataatagcgggaatcttgtgtgtagtctgcccattccaccatgccacgaaacaaaactccattggtccatgcaagatcatgatgctttactttcgtctgatgatctatctgccacatggcaactttgtcgattaatgcgcggtcctggtctttcttacttctagcatcaacagtcgtaaagactgcaaacaaggttaaaatcaaaattagtgtctttctcataagtataatatatagttttgctatttagttgttattttaaagaattgcaaatctctgtgttcatcttcttcaattttgactcatcgagttttatcactttacggtcataagtcattaaaccatttacttcgacttcaacatcagtagtttgtgtatagacagctgcagaaaatccacgggaaatcatatctttcagtattccggcatatttcagatattctgctgtagcttctgcggaagtattgaactggatatatccccaattacgattcggctcccagagatgatctttcaacaccagtccgatacctccgtattcgcctaaaactgtagccctttgcgcatcatacagaaacatctccggtcccggatagtgatgtaaatcaagcatatcaccacatgtataatgattccctccacttgccggatttaccaatcgggaagggtcatattgctttgtccattcggcaatttcctgtgtcttgaattgtccccatgcttcattgaatggtacccaagtaccaatacaaggataagaataaagacaatcaatcacttccttccattctttacgatacgtctcttccgattcagcagaacgagtcaactccgttccctcaaaatattttcggttttgccactccgggcttttatctccactaggcatatcctgccatacgataagccctatctggtcacagtaagtataccaacgtgcaggttctactttgatatgtttacgaatcatgttgaaaccaaaatccttagttttctcaatgtcatagcgtagagcttcatctgtaggagccgtatataatccgtccggccaccatccctgatctaaaggaccaaactggaacaagtctttattattcaactgtaaacgcacaataccatgttcatctctttttatcgaatacttgcgcatagcaacatagctttttatctgatccaccagtttccccgcagaaatcaaagatacttccatctgatacaggaaaggactatccggcgaccagagctttgcatcagcaggcatgggaatctcaaccggcaaaccatttatagaggttcccatagccaccagatgctttccatcaaacacttttacctccagcctatccgactgtctattgctatccgtttcaacttttacctttattttatttgtatctatgtcgggagttgtctttatacctgcaatataatgctcggacaccggttccagccacacagtctgccatataccgcttaccggagtataccaaatgccacgagggttactaacttgctttccccgaggttgaaatcctttatctgtagggtcccagactttaacagtcagggtattcgttgatttctccaaagcttcagtcacatcaaaagtaaacggagtaaaaccaccggtatgttcacctacttttatattgtttacccacacttcagttttccaatctactgcgccaaaatggagcaatactctcttgcctctccaactggaaggaatattaaatgcacgttggtaccataattctttttccatccccaaagtttttcctacaccggaaagacttgattcaatagcaaaaggaactaatatctttccatcaaacgtagtcggagcagattgtcctaaaggtaatacggcatagttccatagcccattcagattctgccaatccgaacgttccataataggacgcggatattccggcaatacattattcacatcgaccttttctgcccaaaaagttctgattttatctcccgcaggtttccactgcgccaataaaatttgagaagagaataaaagagctgtacccaaaagtgttaaatgtttgatcatatataattagattattgtttcgactgattgacgcagacaaaattagcggatgagatagtttttgggtaatataaatatcccaataaatcgcaataatgtctcaaatagaagaaagaatagcaaatctataccaaatgaaacaggaatgagataattgtttcatataccacataaaagcacataaaatattgcaataaaaaaagaggcagataagctatatatacgcaatatgcaggatctatatgccctgtacattgtgtatatatgcgcaatgcaacggggatatagatcctgcatgtacgagatactatctaaccggcaaagtctttaggcaatactccaaactgtttctggaaacatttagaaaaataggaaggcgagttaaaacctaccatataacaaatctcattcacacgcccattcccctctttcaataattgggcagctcgtttcaacctttccaaccgcaagtattcattcgggctcagatcaagtactccttttattttccgataaaaattagagcgactcatattcaatgaatcgactatatcatccatactaaaatcaggattatgaaaattaccctgaatgatttcatttagttttttcataaattcttcatcagcttttgtcaaagccatcgtattggccgcaacaaaaggcgattgtgcaaaagcctgacgcaatttctcacgactattaatcagattagcgatgcaagcctgtagatattcaacagagaaaggtttttcaatatacgcatctgcccctaattccaatccctctatcttagattgaatatttgttttagcagtaagcagaatcaccggaatatgactataatccagtttagacttaaccaccttgcacaactcaaatccatccatacgaggcattacaacatcacttaccaccaatgtgacttcctgattatccagcacttccaatgcttccaatccatcttttgcagtcaaaacgatgtaattatcttccaattggcgaacaacaaaagacagcatatcctgattatcatccgctaccagtatcacaggcctatttgccttactttccccctgttctatccgacgttctaccgttttactctcttccacagatttatgttctgaagctagttttatcacactatcctgttctacaggcagcgacaaacaaaaaacattagcttcttcactttccaacatcgtcaagtttcctcgatgcaattcagccaatgaacgcgaaagagccaatccaattcccgttccggtagtaactttaccatcttccttctcattaaagcgaacaaaaggtttaaaaatctcttccttcatttcattcgggataattactccgtcattcacagaacgaatataaaacatcttattttctcccgtcccatttatttccaagtacacatgcacatacgtttctgcatatttcacagcattattcagcagattactaacaattttagtaaaagcctccttatttacatgagcatagaaatcctgtactggtacatttagaatgaaatccaattctctttgcttcgccagagaagtaaaacgtttatgagtttctttcaatacctccgtaatattacattcagcaaagttcaatcggaaaccctgactctccgtcttgcggaaatccaacaattggttcgtcagacttagtagccgttctgtgttctgcttcattatattcaagtcttcacgcgtctccgagtccactgactttttcaaaagaatattttccaacggaccattaatcaacgtcaaaggagtacgtatctcgtgcgctacattggtgaaaaaatctattttggcattatacacttcccgttccttttcctgctcaaatttttccatttgacgacgatgctttctattggtgcgacgcttaaaataaagaaccaaatagacagaacatccaataatcaaaagtacataaatgcaataagcccaaacagaaagataaaaaggaggtagaatctggatacttaacgagatttcattactattccataccccattgctattggcggcctttacccgaaatatataatgaccataacgcagattagaataagttatcagcgggctttcgcctacagatagccactcatcgtcaaatccttctaatttatacttcaatttattcattctcggagcttgataacctagagctgaaatacgaaaagagaaggagttctgatcagcccgaagtactatcttatcagagaaagttatactcttttccaaaggagaatttggctcatctgcatacacttccttattaaacaacagaaaatcagttattactactgtaggaagattcttattctctgagaaatctttaggattaaaagcaataaaaccgtcaattcccccaaagtaaatcattccattctcatcttcaaaactagagcgatagttgaactgatctcccaacaaaccattcgcagtagtatacactttcatagcctcagtatttggctggaaacaaaccagaccattattggttgtcagccatagctgcccttctttatcttctacaatctgataaacaacatcactaggcaatccattagtagagttgtaactcgtaaaagtctccgactccggatgaaatatacagaatcctcccccttgagtcgtcaaccaaatttgacgatgggagtcttcaaatacactcgatactttattatatggaagacttgtattatctttatcatcatgcacatagttcttccacttccgatcgttcacattataacaatatactccgttagcataagttgccagccagatattaccggcagaatcttcttttatatcatatataaatttcccgtttagttccggtatgcgatcaaagtcatccgattgcttattgtatcgtaccaacccaaacatagttcccaaataaatatcacctgtagctgttttacagattgcaaaaatactattatcaatcaaagaacggggagaatcatttttttgatatgtttttaaaacaacacctgaacgggtgtctatcacctttagccccttagagaatgtacctacccaaagtttatcatccactaaacaaagtccatgtatattcgtaaatcctgcactaggagcaaaaaaagaaaagtctttcgttttcagattgaaacgatttaatccaccatcctcagtaccaatccataatataccttgactatcccgacaaaattcacgtacccgcttaccatgcagactattttctattcctttcggataatacttctcaaaataagtatacgaacgaggataataatttactcctccaaaatatgagccaatccatatcccatcttcacggtccttacaaaacgaataaatagcattgtctgataaagaataaggatcatattcggaactacgcaaatgcgtatacttttccgtacgaagattataaatataaacacctgattccgtccctatccacaactcattatcggtatatacaagtagagtccgacaataaatagactcattgttttcgtctttcagcaacaagtccctcaatttgcccgaagtcaaattcagttctttcacccctccttttaaagaactgatatataaacaattgtatgcccctgatactattttactaacaacatcatcattataagtttcttcattatcaacaggtgacagataggggtgaagagttttcaaattatctttcgaataaaatagtccatctccgtagaatccaatccatatagtaccgctattatcaactgtcaaacatttcacgttagtagaaaccaatgaatgttcagtcaaaatatagtttcgtaaactttgttcttttaagtcataacaaaatagattttgcgcctctgaagctatccagatacgtccttgtttgtcccctgaaatcatggcaacagcccgttctatccttgtatttttatcacttaattctacgaaatgacgaaaagtatctttttcaggataatatatatatactcctacatctgtccctacccatatatttccctcgacatcttcataaagagaagtcacaaaattattgccgagacttcgcggattggttctatcatatttaaaatgccggaacgatacgccatcatatctgtccaatccatctttcgtgccaaaccacataaagcctttcgaatcctgcaagatagcacttactgtgttttgcgacaatccattctggctactaagacttttaaaataataatgttcatctatcgtttgtgcacggcaaataagtccaattatcaaagcaacaaacgttataataattttcttcatatattcagttttataaggctcctttattcaactaatcaaatgtagacaaaataacaactgaataatagaaaatatgtcccaatgaatagaaaaatagtcctatttttctattcggatacgcgcatccaccgctataaccgccttctcagtggccaggagcgggtttatgtccatttctttgatttctgttgcaaaccggagcaaggtagacaaacgaacgataatttcagcaaatttatcctcgtttactcccttttgtccacgggttccctggataattttataggcgcgtaaggagcgaatcattgaataagcctcctcataagaaaggggtgccaagccggaagatacatctttcaggacttccacaaaaatgccgcccaaaccgcagagtaccacgtgcccgaacttttcttcatattttgcaccaataaaaagttctgtgcctttgagcataggttgaaccatgatcgcttttgcatcgggaatctgcatcatacggtcaaattcaagtgccagatgctgttcccctttaatgttcagtactacaccaccgacatccgatttatgcacaggacctactactttggctactaccgggaatccacatcgacgggcaaaatccacgacttcctcctttttattggaaacatattcatcgaccaatgaaataccggctgcgtgcagcaatgcctgcacataatgaggttcgatatatccattctccgggatggaatcaatgatacgacggattctcggtacatcgactccgaacagttcaatctcaggcaccgccggtttcggggcgttgacaatgcgagacagtgcagttcccaaagtcacttcgtcggaaaagttcacgtgtcctttggcaaggaatgccgccacttccgctcctgctgtattgatggagggaagaacagggaatataggcttgtgacaggtctgcatcttttcatgaaggacatcgtacatttcaaacatggtcaccagtccgggtgtgccgaagatagccaggatagcatctatattgtctaatttttcttcgcaatagtcgatgcagatacgcaaatgatccggtgtaccggtggcaaggatgtcaatcggatttcctacggaagctccgggaaagagttgggctttcagttcttccgccagttcaccttccagcttagggacattcagtccgcctttgctcaaagcatccgtcagcattactcccggacctccggcatgagtaatgatagcaaagttcttccctttcagttcggggagggtgaagatacaaccaacggtagtcagctcttcgcgggaaaagcaacgcacgattccggctttacggaacagcgcctctacagccgaatcggaactggcaatcgctcctgtatgtgaagaagccgcccgacttccgctttccgaacttcctgcttttatcgctgcaatcttacaacctttccttattaatgaagaggcatggaagagcaatctgtccgggttgtgaatactttcaatatagagtaacttgatacgggaatctttctctggatcaaaattctcgtccataaattgcagcacatcttccacaccaatctgcttggcatttcctaccgaccagacagaattgaactgcaatccttttgtcaccgcactttcaagaataaagaccgccgtagcaccggagctggagatcagatcgactccttttgagttcaagttcggaataggctggctgaagacgctatgatgccatgtattcatcagtccgatgcagttcggaccaatcagtgaagcaccatatttgttgacagtttccagtatacgttcttccaacaacgctccttcgcgtgtctcttcaccaaatccggcagagagtatgataaatgcccgcgtctgcttctcgcttgccagtgtctctactatatctggacacatcacagccggaacagccaacacagccaaatcggtatcaggcaattcttttacatctgcaaaggcaggaactccctgcacttctgtctccttcgggttcacagcccggagttctccctgataacctccgtttatcagattcttcaatatagcgccacccggcttatgtacattattcgaagcccctactacaactatactctcgggacgaagcaactgggttgttatcatatcatacactggttttcgtttaaactaggatacaaatatattctttcctgcgagaaaaaagaaagaaaaagaggagaattatgggtggaagtttttagaaacagaagaaaacatttgggttatgctatcataagctaactttttggtcagttcatgttcattcactacaatcctgttatttccatagctctatcttgatatcaatcaattactgtttttttctaaaagaaaagaagacaatatcaaggttcaatatagttgttattaaaatgaaagacagcactagtagaattaactgaaatgccctaatatagttaactttatttagccaatccatatcagggcaaacagaaacggcataaactttacttatacaaatacgattgaggcaaattagtaacaaattgaatcatttgcagatttcggtttaaaagaaaagtatccaaagcacatcctagttctttaaggtaaatattttccttaatcttatttttcgagggataatatagctgatatcctttaattctatcaaatctcaggagacacgtgtgaaattcactccacaattagtatctggtacgcatttatcacgtacttcctttcttattttttgaaaatcttcttcatagtcaaaatccagactgtaattgccttgtgtatcatagaagtaagcaaacttataaccattatcagctatcatctcacctaaatcaaactcaattttaaaccatttttattcttccaaaaaacaaacattgctcctttcttaaattggaacgaaatttcctttttatataaagataaatgctgcaaaaactcttcccgacctgatacatttttatatgccgccttatcaaagtcatcaaatgataaaaatgtgtcatcattaacttcattcgttattttccaacaatagttccaaagttcattcacagtagggtacttcaaattcgcacgaaaatacatctttacttgactgtataaatcaaatttaaagtcataatcagtagaagtatcatataaagctatacttttacaactatataggactaataatagtacgattaataaaatcctaattatcggtttcatttatgatataaattaaagatttataggaatattgcaaaatctaatataccctcactaaaaatcttcttcagttgttgcttcgcactattcttcaaaccatttatagcgatgcttatccatcgcatatccagctacttcaccattaggatatatgtcgtatatactgtcatttacaaaaaaatgataccagctaccaaaagggaaatatggtgtaaattctttattccaaacaatcccttgaatagtatcaggcatttgaataatagtaggtgcaggcacataacaaatggagtcgtaaaataaatcatataatttgtgaacatattcatgtggagacgtatctttcaatttaataggttgttgtgcagtgctaagataaaaactcattcttccatgaggagcaatggaatataaaccgggagaatattcatgaaattcaccaaaatacctattgacttctacatctgccataagtggcattgaatattctccgttttttattataaagctaccatataaatcaggattcaatcctatcaaaagactagaatccgatttattatagacagacatatttaatgaaatcttatcaggcgaagaaaacttttcagacttccctttttctccatgaacacttatatcataaattgcaatatcaattacagcggaatctttatctccaccattaaaatatcgtaaattaggatattcccaaattttagttccatattcaatttgctcaaaagcagatttacccgattccttgtcttttacatatatccaaatccgttgatcaatttcgcgagaatcaggcatatcatcctgagacgatatgcctaatagtctactaatttccttttcacttagtctctttttaccttccagataaaaaagaatatatttatctttatatctcatagcatttgtaggcaaaattaacctaagttcatccccattttgaccagtatcaaaccaaaagccactttgcttaggccacatactatatacataagtttttctagaatcaaactgagaaacttttaaagtcttcccacaatcaggatagaaatctatcactgattttacatgttccaaaagtataggatctatactatcgtcatttgacccctgacaggcaactgccaggggaatagtcaatactattgatacatatatcaaagaaataatcactttttttctcattatcatcttaattgttgaaatatatatcgcattaaatcattcatggaattaactttaatagaatatgtgctattgttttgatcagtataattaataatattatctttataataaataccatatcgtatatctctcagcattctagcattatccatatcctcaggtgaagcaaagggattataaggatgagaatggatatctattattggtataaaggtaggaaataaagcctcttgcactttagttaatccatacatacttgaaactctattcctattattatttgtacctaatataaatgttctctttccatccatataacctcccttaagagtccattccacacttgtattatccgcaacaaataaaaaaacattagcagcattatataccgagtttgtcgtagtgtaaagcttacgatcccaatagtctctccccttttcccctttactcgccgttaatccctgcaacatagatttatcaaacacccgaatacttttccaatttggatcaggctgcgtcgctttttgagaggaattaataccacttgcatataaaacatctactatcctatcagtcttacgcatcaagtaaactgctccatttgcatttacaacataatcatcttttccatcagggtcaattcgtattattggactatttttacagtaagcatataaccccaaagcaggatatttttctcctgaaggatctactgcatgccatcttcccaacgaagcatcatacattctcgccccataatcataccaatccaaaccattatctctgttcagttccttgccgttatacttataaggctgaacattattagacaatgatgaagaaagcaaccctccgaatggataataatcattcacttcctccaccacaccattttgagtgacaaccacacgattattaccttgatgatcctgaataaagtaatgaaattgattattcgaaacggtaatgtaaccatcttctgtcaacacctttatcaacacaccattttcatagatcgcattgccacaatagtctgttatgatagtggcatttcctgtcttatacgtagtacggagttttgttccatcagccgcgtagaggtaagaaatactgttaccaccttcaaactgcaccttctccggcaaatttaaacaattgtattgaatgtcagctatctttttattcaaatctttcgtcaaattaccatttgcatcgtattcatactctatctctttacttgcgccatccttgaattccataccgttaccgaatacatggcccgtagcattgtcgttgacagactccaattggttaccgttgtaaaccaagtttaagttatcaatcaagccatagctcattgtattggtttgcccgtagcggagtaaaccgaggatgtttccgttcttgtcataacccgttacctgttcattgaaacgattcaaattattgcttaattgctctccttcaccgtaaatggcatctttcaagcgagaaaagccgtcatatgtaaacttatagccacgtaatccggcctcacttcccgaatgccagatcatactactgatattgccattataacagggaacacctactccatcaacatagtgtaacgtttgagaaaagtgctgactttcgattccagtcagccagccacggatattataggataaactctcagacaccttatcaccataattcctgccagtcagacgccccaatgcatcgtatacataagtgattttatcggtaaaacgcccgttccaagtattggctttcgttagtaaccttgcacgatcatcgtacgtataaacggtttcaaggatatccgtaccaatgttatcctgctttctcaagacattacctgtgaaatcataagctgtatgacgatatcgcaaacccttttcaggataatgacagagcgtttgaatgacacggctacgatcatcgtagtagattgtctctgtcagccagtcatctgtgccaagcaaacgtgttttcgtacttgtggtcaaccccgaaggatacagagtatacggcgtatcatagccaacggctgctacaaacggatgagcagtcacattctccgttggtttgtaattgtcatataccgtatattgcaatggagtgcgagttcccgaaggaagataatgctcgctttcccaagcggccaattgcagttcgccgcacgtttgctctgccgataaaagtatttcaccgctttctattacacgatcatgagaatcatagagaaaatagctccatttttttgtatcggcagtccggcgtgttccgtcctggctcaaaaccagacggtcacgacagtcataaaccatataaatgggagcgcaacccgggagacgtttggaaatcatccggttcagtttatcatattcatagctgtatgctaagctatgcagcacggagatatccgtcgtaccggcctccgccagccgatggctggcttctggaggcagtacataacggagacaattgcggtcatcgtacacatagtaggttgccaagctatcttcaccgttgacagatacagtcagaagagttcgttcattggagtcggtataggttttactccgatgcccatcttcgtctgtttcaacaatgacttccagtttccccgctccatagaatcctgaagcgatcaatgagccgctggaagaaaccttatagcaccttacctcatttgtactgttcatcccgtaagtcacacggacactcttatcactggtatgccacgccttgcctggtcccatcttccgggaaacacgcatcagtggactatcctcatattgagtcagattataagcatatgcctgttctcccgtaccgtagacactccaacgctccggggaaaacttatcaaaggcaccgttgttaccggtctttgcatacggaaggtattccttctctacttgacccatcatattgtaggtataagaaagtaccagatccgcattacccccaggactgccgcctacctgtatctcctgttctttacggccaaaacagtcggtatagacaatatcactgacaattcgtgccccaccgctacccgtttggctactcgcatccatataagttcgctctgccgtataattacgtgttttcgtataacctgtcgcttgctgcccgttcatgaaaagggaaaacgacagcagacagagtattgacaaagttcgtttcatctctattgttttcatattctgtatcttgttttattagttattaagcttgttgtactcatacgtttttaaaatattaccatattggtcttccactctgactactcgcccggcagcatcgtaagtgtaatactccacatttccgctctggtcaaatcgggcatacaccgtaccgtcaggattataagaagtggccttaaaatttgctccttcagggaccaatgccatataagaaccttgagtattggcagttacagaggttatgtctgtgtatttacttaggtcaatatcatatattttcaatttagaagaagaaacgctctcaacggtatatggaacctcacttcctgcatgggtgatgcttcctgaagcagttgcatttccgtccaaaatatacaatcgcaagtttttcataccggaagccggagttaatttggggagataagcaaatttgtatttatctacttcaccatacaatccgtacaagtaatcgaataatgatagtccatcaaattgcatcattgcctccattgcacttataaattgtctcaaaatctcaaactttggatagagtcctatcatccgttcatattcttgtttaaacacattaaataaatcataacatacaatatgttcataataatatctcgcctgactcaaatccggcttacttttcactatttcttcagcaaatgaagctataaaggaatggtcttgcgagttcagaaagcgaagaaaatgctgattatccacttcttctttaagtacttctattcctgacgcaaaagtccgttgttgttttctcaaataattgatagcaaatttaagatcagcctcatctatcgcctttcccactcccttatatttatcacttgccgtagttcctattacatcacactccagtaacagtttcccatagctgtcgtaaacacggctcttccgttctgtcctcccgttggtttccacccacatctttgaggcatatcgataagaagcttctgtagtatagttactttccccatgactaaacagtattgtatcaactacgctctgagcataagcttccggcatatcaggaacataagtcaatacctcaactggagctatgaaaccaatttttgattctctgtcaacctgatagcgacacacagtctcatgtactaatttttcatcaacaaggataagtgacttcacaacaggcgaaagaaaattggcttctttcatcataacaaagacagaatctgcagtgtctgccatatccatcgcacgcttcagaacttcagtccgttcaataccatcagagccaatacgaatgacacaggtgggatacatcgacatcggattatcataataatatttcgtccgagaatacggaatattttcgtcacttctgtattctacttcttcttttagagcagttctccagccatattgcagattgtagaacttgtcagtattagtaggagataatcgtggtttgatattatactcataaatctcttttcctgtaagatacgaagttccctgatttctataaaaagattccaaagacttcccatctaaataaaaatcagagggttgcatttgcggaagtttatcttcatagttgacatcagtttcataaatgtattgaattttctttagcatctctccattagtatcatacactgctttctccctcaacaaaccattctcccaatatggataatcagattcgttcactgacgtaggaggagatacttgataactatagacagtagaacccctaccggatatagtctccgtcacacatgaatagtaaagaccgttattacccatatttatcaccggataaccttcctgtatcactctgctatactcaatccagtccgtgcattctggataagagatactgacaacattagataaaggcttatacacactcacgcctactctcggataaccgtaagaaatggtatcactacgtccatttaattcgttactgaataccaatgacttcaaacgaattcctccgactataccctttctcccatagtttctttcatatttgacttcgattttccctccatccgataagactatatttttcagcgagttaagagtagcatatatctcataatctgtacactcttcatcctcatcctccgcataaggatatccccacaaatctactcctgtctccttccaaactggaaaatcagacttttcataataattgaattcaataccggatgttttcttgccgtttttatcacagaaagccaatcctctcgctaatgctcctcccgtggacgaaacagacgaaattagttccatatttcggttgtacaaactgatagcagataagctagaggaagacgaaaaataggcaaattttacaatatattcaggaaatacgattctgttgagcaatggagaatgaactttatagctttttcctccccatatctcttttgttttaacgtatttaacctcagataaacaggcgtatatatagtctgctgcttcctccaaatacgaaccagccatatccgcattaaatccgcctatacgtttacaatatgcagcgaaacctctcagactttctcccaattcttttgatacaccattcattttcgaaatgttggacaatacaccgacaattcgattgttagtttttatatattcactttgtagaggttgaatatttatccggctatatctttcaaaatcttttattttagagtccacatttttaaaatccagcaaaagagaacacatattcaaatagttttgggctacctcaatagcagaataaaaccgagatttatactggtcaaaatcaaacggttgttctttcacagattgaccatagtggtaaatcatcttatatgaatcatagattttcatagtatggatactatctaatgatagatttccaaaatctaaatccattacatcacctttatagcagaaatcaatcggtgctccattgtatggaagaatacgggtaagatgccatgccgaggtataaccggaatctgaaatagcattggaagtggaaacatccacatactcaacatctgcacatatttctctctgccggtagatataacggtcaccattattatctgtaatagtccagcctgttatctctgtggaagtcccttcacactcaatgcgaacatctgtctgtcccaacggcaaagcatatatctgtcttttttcattcatacggatgataaaatccaccttcttcccattgaacacgacagtaaaaatatcgctttccccatcccgtttacgaagccccacagtccttgcatcctgttccaatggagtaacagcattttctgtccacaggtagccgtaacctgatttctcatcggcaaatccaccacgcattgttcgggtaactataccaccaacgttaagtgtccaattttgacctattaaaccttcaggatcactcaccttcactccctttgcaatataatccaatgaaataggtaattcataatcacctgactttaattgatacagaggtacggtgtagtggaacaatcctgttgcatagtccaccgttacgttctttctttcggtcaggttctgggcttccggaccaggattgaaatcctgtgcctttccggatatagtcaccaataaaaaaataataatgtatatagtttttctttcataatcatttgtatttaatatctctagtttagtttttccgtttgccggatcgctaatcgataccggcaaacggatagtagctgccttacaaactcatcgcattagcccccaaaacgcctgctacagccgacgccaccgcgataaccacctttaggatcatatcccatactgatttcttcattgccatcatttacctcctttctcgttctttaaatagtttagtttactctgtgttcctaccgtattttcctccggagaaagcgtacgattcccctgcgtggcggaacaatgcaccacgatcaaattgatagttctcatgttaattgataattctctgtttagttgattgtcttattaaagtcctagtctttaaccaattatcattagttagtcttttgctggttatccttagttagctctagtttgtttcttgtttctttatttttctgttttacagttacagttcagtcgttagtcttatatttcttcccgcgaagcaagaaacaaattatactgtcgggtccggtgcttctccatcatctccgccatcgctgccaccaccaggcttgtcattcggatcatcaaccgatccgccgtcaccaggcgcggagaccagcttgtcatagcgggcacacttggcacccgtcaccatagaacgggtagcggtggtacggtccagattcttcgtcgtggtaggctggaagcggacggtaagcgtagcctgtgcagcactcacctcatcggcggtctcaacaccccggccacgggcactcatcaccatgcggaacgttcccaagccatccacactgacgctttcggacgactgaagatgctgcgccatcaccgtcaccagattgtcaagcgtattttttacatcacccggagaaagggaagaatatgcggcaatctctttggaaagctgtgcggaattgatatttcctgtacgaactacatggggataaaacagtttcttcccacttttcttatcttccagattagactggaaaggtttatataatactggcataattgtaatagtttttagttattaatctttttgttagtttctgtcgttaagcttattgacactgcaaatataagggcttattctcagctatacaagcgatttcggaaatgtgcgttaataagttagttaatacaagaaataagcatataacatattgatatacatatatttatcaaattcatattatttattcagcacactcagcaaataatgtcccggcagtttaatcttcccaccgcttccacgaatgacgctaaagcctttccatatatcaccaccgatttcaccgtaattacttttcagcactatagcatactgttcagcaggaggaacacgaaagagtcggagattctccagcagaccggaaaaattgcggggacatccgtccgggggaacctgcatccggtcgatatcttcctgcgtcagattccgtttcctcgtggcagatcgctgatcgcattcttctctcatcccgcctccggctccttcagctactttctctccttcactcccttcttcttcttcatcccctccttttgcgaaaggagggttagggaggatgttttctttcttttctttttcttttctttttatgagagctgtttttgttgcagtatcccgggatgccgttgcaatattcggggatactgcaacattttcccctgttgcggcaacagtatccggctgctcatccgttgttttcccttccggcagcagacaataatccggacagatatggtgacgactgcgacgtttggtgatgaagagatactgccgctggacatcctcagaagtcagaatgctgtaacgctcataaagcgcagagtcaaaaagcccgtattcaagaaacagacggatgacacggcggacggtatcgttgtccgtactgaaaagctgatcggaaagttcgtcacagaaatcggtgtcggcacggacatagtagccctcgcccgaataaagataagacataatatagattaaaacggtgaaagcggaatcgccctcacgcttcatgacacgacgaacgatacggtcgtgcatgaagtcggtgctcaggggaaagtagtccagtccctgtttgattcttcccatagttgtattgtttttataaatagtttatcagtcagttttttcattttgttaatcagtcagttccgcttccacttcacaaagtttctgctttttccgcttgatacttgcccttacagtctgcagggcggacagaatcagtttctgacgaagatcggggtctttcgtagaggtgataacgggataaggttcacggtcatcacgtgccagcgtgcgcttctcggtcttcctgtatttccggctggcagatttgcggcattccttgcagtagttgtttgaaaggccggttttcttatctacgtaaaaggcttctgaaggaagcgtgtgtttgcaacagccgcaaacgtaaagtgtttgtttttgtaatgtttccattccggttattctttttgatatacttgatatgttttcagataaaaggtaaggcagcctgcgcacaggaggttcacatcctacacaatgatcattggcaacttgcccgtcagatgttaacagccatcacgtcagctgttaatacccaatatgacaactgttaactcctgacaaatcaactattaacagctgacagctctcttttcgaagggggagaatgcggtttttgaaagtatttcgcatctttttcttgttttctcatggtttatctaatttttatttctaattttgaaatcaaatattcatttcgaataccacaaaggtatagaaagtcgcatatataaaacaaatgattttagatattaacgctgaattattttacaaaagactgtatatgaggcgataagacaagaataaatattaacatataaaaaagtaagcaaaaacatgaatgagaaacaagcggatacactgctgaatgtaccggaaatcgtaaagcgggcgaaaatagcgttgaatctgaaacgggacagtgaacttgcatcatatttaggagtagccagagcgacactttccaattggtgcgcgcgaaacagcatagactttcccttactgctgaacaagctgcatcatgtagactataactggttgctgaccggaaaaggaagtccgctgcacgacccgaagtcttttgacaacggaaagatacggggagaagtagagactattcacaattcaaaaaccacagaagccatagacgaccggagtgtgacgctctatgacatcactgccgccgccaatttaagaaccctgctttccgacaagcgccaatatgcgctaggcaaaatactgattccgagcatacccgcgtgtgacggagccatctttgtcaacggagacagcatgtatcccattctcaaatcgggagatatcgtagggttcaaggggatcaacaatttcagcaacgtcatttacggagaaatgtacatcgtggcgttccacctcgacggagaccagtatctgacggtgaaatacgtcaaccgctcggagaaggaagggtacgtcaaactcgtcagctacaatccgcaccacgagccgatggacttgcctgtagacaccattcaggatatggcaatagtgaagttctccatcagaaagaatatgatgatgtaaaaacggcacaggctaaacaagccttttccacagatttcctgtcacatttcttcctgaaatctgtggaaagcattatctttgcacgttgcaaaccgtatctttgcacattgcaagcagtaaaatcataaaatcactctatatcaatggaaaagaaattcaagagaaccaccgtcacatcggcactgccgtatgcgaacggacctgtacacatcggtcacctggccggcgtatatgtaccggcagatatctatgtgcgctatctgcgactgaagaaagaagatgtattgtttatcggaggttcggacgaacacggagtacctatcacgattcgtgcaaagaaagaaggagtcactccgcaggatgtagtagaccgttaccactatctgatcaagaaatcgttcgaagaattcggcgtttcgttcgatgtatacagccgcaccacttcgaagacgcatcatgagctggcttcggatttctttaagacgctatacaacaaaggagagtttatcgaaaaaacatccgaacaatattacgacgaagaagcgaaaacattcctcgccgaccgctacatcaccggtgagtgtcctcactgccattcggaaggtgcctatggcgaccaatgcgagaaatgcggaacctccctgtcgcccaccgatctgatcaacccgaagagcgccatcagcggcagcaaacctgtgatgaaggagaccaagcactggtatcttcccctcgacaaacacgaaggatggttgcgccaatggattctggaagaccacaaggaatggcgccccaacgtatacggacagtgcaagagctggctcgacatgggattgcagccgcgtgccgtcagccgtgacctcgactggggtatccctgtgcccgtagaaggtgcggaaggaaaggtgctgtacgtgtggttcgatgctcctatcggatacatttccaataccaaggaattgcttcccgacagttgggagacatggtggaaagaccccgaaacgcgtctgctccacttcatcggaaaggacaatatcgtattccactgcatcgtattccccgccatgctgaaagcggaaggaagctatatcctgccggacaacgtgccgagcaacgaattcctgaatctggaaggagacaagatttcgacttcccgcaactgggcggtatggctgcacgaatatctggaagacttccccggcaaacaggacgtactccgctacgtactgaccgccaatgctccggaaacgaaggacaacgacttcacatggaaagacttccaggcacgcaacaacaatgagctggtagccgtatacggcaacttcgtgaaccgtgcaatggtgttgactcagaaatacttcgacagcaaagtacccgcctgcgcagaactgacggattacgacaaagaaaccctgaaagaatttgccaacgtaaaggcagaagtagaaaagctgctcgacgtattcaaattccgcgacgcgcagaaagaggcgatgaacctggcacgcatcggcaacaaataccttgccgacaccgaaccctggaaactggcaaagaccgacatggaacgtgtaggcaccatcctgaacatctctctgcaactggttgccaaccttgccatcgctttcgaaccgttcctgcctttcagctcggagaaactccgcaagatgctgaacatggaaagcttcgaatggtcggaactgggaaggaacgacctgctcccggtaggacatcagctgaacaagccggaactgctgttcgaaaaaatagaagacagcgtaatcgaggcacaggtacagaagttgctcgacacgaagaaggccaacgaagaagccaactataaggcaaacccgattcgtccgaacatcgaatttgatgatttcacgaaactcgacatccgtgttggtaccatccttgaatgtcagaaagtgccgaaagccgacaagctgctgcaattcaagattgacgacggactggaaacacgtactatcgtatcgggcatcgcaaagcactaccagccggaagaactggtaggcaaacaggtttgctttatcgccaatctcgcaccgcgcaagctgaaaggtatcgtcagcgaaggtatgattctgagtgccgaaaacaacgacggtagcctggcagttatcatgcctcagaaagaggtgaagccgggcagcgaagtgaaataagcaataagctaataagccatcaacaaatgaggaatggaaggatggggtgtcaaaatagtaactaaactctcctccttcgggaaggaggagtacccgcagggggaggtggtaggtgaatacatcaactgatgatattcacttgtgcagtacacctaccaccccggctttcagccacccctccttcctgaaggaggggaatttagttactactgacttttgacacactctccttcaccgattataataatatgagtgaagaacagtcactgaaacaaaaaacagcaaaagggctattttggggaggcctcagcagcagtgtacaacagctgttaggacttcttttcggagtagtgttaggaagattactggaccctgccgattacggtatgatcggtatgctggctatctttccggccattgcttccgccctgcaggaaagcggatttgtcgcagcactcgccaatcgcgagaaagtcagcgataaagactataacgctgtattctggttcagtatctcttttagtgctgttctttatattttgctctattcttcagctccgctgattgctaaattttacgatactccggagttaacgtcgctcgcccgtttctctttcctcagtttctttatagccagtttcgggatagctccgcgagctcttctcttccgtaatctcaaagtgaaggagaataccatcatttctctttcaagcctgtttctatccggtattgtggggattattcttgccgcaaacggatttgcctattggggtctggctatacagacaatgacctttgtcgtcataggcacggcactcaactggtactttgcccactggaaacccagtttccgcattgacttctctcccatcagggagatgttcggattcagcagtaaaatgctgattacgcaagtctttattattatcaaccaaaacctgttctccgtcctgctgggtaaattctacactaaacaggaagtcggagacttcagccaggccaacaactggaacaataagggacacgccctcatcaccggaatgatcaacggagtcacccagcccgtactggcaagtgtagctaatgacccgcagcgtcaggcggccgtgtttcataaaatgctgcgtttcacggcttttatttctttccctgccatgttcgggctcagcctcatttccagagagtttattctgattgccatcacggacaagtggctcgcttccgcacggatcatgcaattactttgtatatggggagcctttattccgatcaacaatctgttctctttattgctggtcagccgcggacggtcttccatctttatgttcaacagtatcgcactgagcgtgttgcagctgatcactgcctgtatcagttatccatacggcatcaccaccatgatttatctgtttgtcgctatcaatatactttggctgtttgtctggtactgctttgcccggagggagattccgctgacgctgttcagcatactgaaagatatcgctccttattttctactggcagcttcgctgacaatcgcagcccattacataacgtcgggcatcactaacctgtatctgtcacttgccatcaaagtagttttcgtggcttctctatatgcacttgttttgtggaaaatgcaatcagtcattttcaaggagtgtattcagttcattaaaaagaaaaagatatcatgacgacacctaccaattacatagcgacctggttctacaaggaatccaaagaagatgccagtttctatccgcaggcaggcaaacggggagattccgccctcgtccattccatttatatgcagatacaagtgccgttctttaccactttcaggcattatcatcccaatgataagttgcttttcttcagcaatctggatcagtttcccgattatctggaacggttattcaaggagttacggattgagactgttaccctgccttatctctgcatccctcccaaaggatggtacggggcatggagaaatcaattctatctgtatgatatcctgcgctatatggagaaaaggatgcaggcggacgatacgttgctcatctgcgatgcggactgtctctgtatgcgtccgttggggcaactattcagcgacacacggaaatacggttccgccctgtacgatgcatccgaccgaccggacctcaaagtgaacggaatcacactaaaggagatgacagatatctataatgactgttacggagaaaaagagaagagagaaaaagagaaggaggcaacgaagaaaacagaagcggaaaaggaagaagcagagcagcaagatacgaaaaacggagtcacaagaacagagcttgtccattattacgggggagaatttatctcgctgcgtggtgatgtagtggcacgaatcaacgaagcgtatcctgctttatggaattataatctggaacgttttgccgccaatcagcccaaactgaacgaagaagcccacttcctgagcgtagtggctacgaggctcaacatccacaacaatatcgccaatcaatacgtcaaacgcctctggacctaccccaaatacaatacggtagaaaaaggagacgagcaactggcggtatggcatcttccctacgagaagaaaagaggattgtatctgctgtacaaacactttgtgaaccaccccactttcgacgatgaagaggccttccgcaagaaagcctccgcctacaccggtgtgccgaccgttactttcggcaaacgcatccgcgatttcatcaccattctttctctaaaaataaaagacaaatgcatatactgatacttccaatgtactatcctgagaaggactcctccccgcaccggggatatatgttcttcgagcaggctatgcaactggctaaatcaggctgcaaggtaggacttgccttcacggagcaaagacctctgaagaacttcacatggaaacggttccgcaaagagagtcattttcagatatcggcagaagataacggcagtttcgtcaccatgcgcctgcacgcatggaacccgaaactaagcacccgcgcgggaggaatcatctggtctctgctgaccgtcttgttagtacggaagtatatccgcacttacggtcgccccgacctgattcatgcgcacttcggcacatgggcagggtatgccgcccgactggtttataaatggtataaggttccctatgtcatcacagagcacgcctcttccatcaacggcaatcagacgacaccgtcacaggcagtgatactgaagaaggcatacagcgaggcacgcaagatcatctgtgtcggcacgaaactgaaacggagcctgtgcgcatacgtcagtgacccggataaagtgaccgtcataccgaactttgtagatacgaacacctttgcattcagtcctcaccggacagagaaaaagaaacattttactttcatcagcatcggaaacctgaataagcgcaaaggattctgggatttgctgactgcttttcactgggcattcaaggatatgccgcacgtctctttgatcattgctggagacggggaagaaatgcagccactcaaaaagttaattcagtctctccacctgcaagagcaggtaaaactgaccggccgcctgtcacgggaagaattgtccgggttgctgggtacttgcgatgcttttgtactggcctcctttgcggagacattcggcatcgtattcatcgaagcaatggcaacaggcttgcccgccatcggcaccatatgcggaggaccggaggacatcatcactcccgaaagcggcttcctcatccgaccgggagatgtggatgcgctcgccgctaagatgaaaacattgtacgatacctacgagtcgttcgacaaagagaaaatccgccagtccatcgtcagccgtttcgactttcagttggcagggcagaagttacggcaagtttattcagaagcattagaaatgtccaagcccccaaaagcatcggaatcatgaaagttacagtcatagattgttcagtatcaggccatcgggaaacgtattataaacagtttgctcagacatgggcgggcatggggtacgaaacgtcgctcatcgctcccgacgggaaaggcatacaggaggccgttgcctttcagcctgtctcagcgcttccgctactgccgcttcctgccggaaaaccgttgcagaaaaagctggttgtactgcgcaatgcagtgattcgactgcgaaatctgtacaggctgcgccggagtcttcaacggctgaatcccgatctggtcttctttgcctgcctcgacgatatgctgcctacattggctcccttatggctgttcaatcttttgctgccctatcagtggagcggcctgctggttcagtccgccctgccgccttaccaccgagggatgcccgacacccgccctttcctgcgaagcaagaactgcgtaggagtaggcatactgaacgaatattcagcgaaaggcctggaaacatttcagcgccacattctgctgtttcccgactttgccgatctttcggctcccgccacaaactacccgttgctgcgcaaactgaaggagagagccagaggaaggaaggtgatatccctgctcggttccatcaatttccgcaaggggataaagttactgttagagagtatccctttattgccaaaggatgaatatttcttcctcattgcggggaaatcatctctcaccgcacaacaggaaaacgacctgcgggcgttcggggagtcaaggaataactgtctgttctcattggagaagattcccgatgaaagctgtttcaatgccctgatagcggagagcgaccttatttttgccgcatacaagcagttcaccggcagcagcaacctcctgaccaaagctgccgccttccgcaaaccggtcatagtcagccgcggcctctgcatgggccggagggtagagcagtacggaacaggccaaaccaccggagaagacaacgccggagaatgcagcgcagctatccgctcgctgtgtaccgaaacaaggatggacactcaggctttcgcccggtacgcccacgaacacgaagtggagaaactaatcacatgttttaatcaaatcagcaagcatatacaatgaaagtactttttacattcggaggaatcccccactacctgaatgccatgctcaacaggctacaggcaaaaggagtagaaataaccgttgtcagcccgaagaaagggaatacgaccatcggcaaaggggtgaaaatggtagaaggaggaacctacaagcatctgaccacaccggagaaaaagatgttctacggaaaaagcgctttccccgcccttcccgaaatcattgcggaagaaaaaccggatatagtggtagtgggatggccctacttcctgcaagtattctttcagcccgcactgagaaaggctatgaagtcctgcaacgccaagctggtgattcgtgaaatccccttccagactcctccctacggaaagatcaaggaatatttcaaagccaatccgatgcacgacgaaggtatgcgcctgctcagcaagggtatcggcttctatctgcgccaatggataacggcaaggatacggaaatactgctacgcccaagccgccggaacgctgaactactcgacagccgcctacgacatcctcccctcttacggagtaaagaaggagcagatacacgtcacctacaactcgaccgatacggaagcacttctcaaagaaaaagaatccgtactggcttccccctccatccttcccccgtgcgaccgtcgcctgctgcacatcggacggctcgtaaaatggaaacgggtagatttattgatagaggctttccggaaggtagccaccgactatccggaagcggaactggtgatcgtaggagacggaccggaactggacaacctcagacaacaggcaaacgacctgcaactggcagacagcatccgctttatcggagccgtctatgacccgaagacactgggcgcctatatgaacgaatcgagtatctatgtgcttgccggcatgggagggctttcgatcaatgatgccatgacgtatggtatgcccgtcctttgtgccgtatgcgacagtacggaacgcgacctggtcatggaaggcaagaacggctatttcttcaaggacggagacgccgatagcctggcaggtagaatcagagagatgttcgaatctcccgaacgctgcaaggagatgggaaaagaatcggaacggatgatccgggaaaagatcaatatggagacggtcagcgaacgctacctgaaggcttttcaagagattcttcgtctcactcatcttcgcgattccggtaattagccggtgaagtccccaaatgcatctttacgtacttcccgaaaaaggactggttggggaagttgaactcttccgctatttccttgacggacttgtccgaacgtttcagccggtacttgatatgttctatcgtcgtttcattgatcaagtccagcggagtcctgccacacgcttgcttgatgactttcgaaaaatgcttcggagtgtagcagagcgcatccgcataataactcacagaacggtgcatacccttgtctttcgataatagctccacgaatttccgcagggtataatccgcctgtttgatgccttctttcggactgtcccccttgtcgggagcatcgatttccttgtgaagctgtcccagcatctcacaaaaaagggcggagaagagatgctgcatcacttccctgtgataataatgaggttcatcattgatcttcgccacaatcaaatcccgataaaacctgaaaacaggatcatccccgccttcgctgatagacttcaccggattgttgtggatatgagcagcggtattccacgttttcttctccattttaataatgcgttgcagaaaacgggtagagaatcccgccagccttatcttatatttaggactcagcatcgtacgactgatcagtgtattgggaagaccgagcagcaagtcgcccgcctgcaactgatacgtccggtagttgatatccagctggatacacccttctgcacagacagcaataaggaaacagttcagccggactgtatcattactatacggaatcccgtccagactgttgactatcgcaaagtcatcgtctatataatcaaggatatgctgactcttcttaaagtcttctatatctactgtcataatgttctctttttccataatctctccttttttactttttgcaaagttggtaaataatagggaaaacagaatgtcccaaactcctttataattgtttgatatatcgtttatacgcaaatagttagccacaaaaagcacaaataacgaaaacaggacattcatagagaaaaatcggtcaccattgacttgttcttttctcctacttttgttctgattttaataaaagacaaaaagagtaagtatgattacagtgaacaaaaaatggatacggctgatagggattgtcggttgtacagtgtggatggcatcgtgcaagcaggcaccggatgcaggagtgaaatcttcttatgcagtcatgcagatagaaccaacggacaaagaactttcttcctcctattcggcgaccatacgcgggcgacaggatattgatatctatccgcaggtgtcgggaacaatcgagaaactctgcgtgaccgaaggtcagaaagtacgccggggacagttgcttttcatcatcgaccaggtaccttacagagccgcgctcaaaaccgccaccgccaatgtggaagcggcacgcgccgctacgagcaccgccgagctgacttacaagagcaacaaggaactgtatgcgcagaaagtcgtttcggaatttagcctgaagactgccgaaaactcttatctcaccgccaaggcacaactggcacaggctgaagctcaggaaataagcgcacgtaacaacctctcttataccgaagtgaaaagtcccagtgacggagttgtaggcgcattgccctatcgtgcaggcgcattggttagcgccagcattccttatccgctcactacggtcagcgacaattcggatatgtacgtctatttctcgatgaccgagaaccagctgctcgccctcacccgccagtacggcgacatggacgaagcgttaaagaatatgccggaagtggaactgattctgaacgacaactcagtctatcagaagaaaggtaccatcgaatccatcagtggagtgatcgaccgtcagacagggaccgtagtggcacgcgtggtgttccccaacgaatcacggctgcttcatagcggagcatcgggcacggtagtagtgccgagcatctacaagaactgcatcgccatcccgcagacagctaccgtgcggatgcaggacaaaacaattgtatataaggtagtggacggcaaagcggtctccaccctgatcaccgtagccggaatcaacgacggacgcgaatatatagtgctggacggcctgaaagccggtgacgaaattgtatcggaaggcgccggactggtgcgcgaaggcacacaggttaaataagaaggagactgattatgaaaggaaatatatttatcaaacggccggtgatggctatctccatctccgtgctgattctcgccatagggcttatctcgctcttcaccctgccggtggagcaatatcccgacatcgcacctcctacggtctatgtggctgccagctatacgggcgccgatgccgaagcagtgatgaacagcgtcatcatgccgctggaagagagcatcaacggggtggaagacatgatgtatatcacgtccagcgcctccaatgcaggtctggctatcatacaggtttacttcaagcaaggcaccgaccccgacatggcggctgtcaacgtacagaaccgtgtagccaaagcacagggactgctgcccgccgaagtaacgaaagtcggcgtaagcacgatgaaacgacagaccagcttcctgcaaatcggcgcgatggtctgcaccgacggtcgctacgaccagaccttccttgccaattatctggacatcaacgtcatcccgcagatcaaacgtatcgagggagtaggtgatgtcatggagctgggcgatacctacagtatgcgtatctggctgaaaccggaacggatggcacaatacgggctggtgccttcggacatcaccggcgtgctgggcgagcagaacattgaagcccctaccggctcactgggcgagagttcgcagaacgtcttccagttcacgatgaaatatcgcggaagactgaagagcgtggaagaatttcagaacaccgttgtccgctcgcgtgaagacggctcgatactccgtctgaaagatgtggcggatgtggaactgggcactatgacttatagtttccgcagtgagatggacagccagcctgccgtactttatatgatcttccagacggcaggttccaatgcgaccgctgtcaataaagaaatcaccgcccagatggaacggatggagaaaaaccttccggaaggaacggagttcgtcaccatgatgagttcgaacgacttcctcttcgcttccatacacaacgtggtggaaacactgattatcgccatcattctggtcatcctcgtggtatacttcttcttgcaggacctgaagagtacgctcatcccgtctatctccatcatcgtgtcactggtaggtacgtttgcctgtctggtagctgcgggattcagtctgaacatcctgaccctgtttgccctggtgcttgccatcggtacggtggtagatgacgccattgtggtggtggaagcggtgcagtccaagtttgacgccggatacaagtcgccctaccttgccaccaaagatgcgatgggcgacgtgacgatggctatcgtctcttgtacctgtgtcttcatggccgtatttatccccgtcaccttcatgggaggtacttcgggcgtgttctatacccaattcggtatcacgatggcaactgccgtaggtatctccatgatctcggctctgaccctgtgtcccgccctgtgcgccatcatgatgcgtccgtcggacggaaccaagagcgccaagagtatcaacggacgggtacgcgcagcttacaacgcttcgttcaatgccgtgctgggcaagtataagaaaggggtgatgtacttcatccgccatcgctggatggtatggacttcactggctgctaccatcgtcctgctggtttatctaatgagcacgaccaagacgggactcgtgccgcaggaagaccagggcgttatcatggtgaatgtcagcatctcaccgggaagcacgctcgaagagacaacgaaagtaatggaccggctggaaaacattctgaaagatacgcccgaaatagaacactacgcccgcgtagcaggatacggtctgatctccggtcagggaacatcttacggtacgatcattgtccgcctgaaagactggagcgaacgaaaaggaaaggaacacggttcggatgccgtagcttcccgcctcaacgcacaattccagtccatcaaggaagcgcagatattcagcttccagcccgccatgattccgggatacggtatgggtaactccctcgaactgaaccttcaggatatgacaggcggtgatcttgctacgttctatgacgcgtccacacagttcctcaatgccttgaaccagcgcccggaagtggctatggcttatacatcctacgccatcaacttcccgcagctctcggtagaagtggatgccgccaaatgtaagcgtgcaggaatttcgccaagcgcggtactcgatgcggtaggcagttattgcggtggagcatatatctccaactacaaccaatacggtaaggtatatcgtgtaatgatgcaggcatcgcccgaatatcgtctggacgagcaggcattgaacaatatgtttgtgcgcaacggtacggaaatggctccggtgagccagttcgttacactgaagcaggtactgggaccggaaacggccaaccgtttcaatctctacagcaccatcacagccaatgtgaatcctgccgacggttactcttcgggtgaagtgcagaaagtgattgaagaagtggccgcagaatcgcttccgataggctacggatacgaatatggcggtatggcacgcgaagaagcaagcagcggtggtgcgcagacggttttcatctacgccatctgcatcttcctgatctatctgattctggcttgtctctacgaaagtttcctcgtaccgtttgccgttatcttctccgtaccgttcggattgatgggctcgttcctgttcgccaagatactcggactggagaataacatctatttgcagacgggtgtgatcatgctgatcggcttgctggccaagacggctattctgattacggagtacgccatcgaacgccgccgcaaagggatgggcatcgtagaatcggcctactctgccgcacaagtccgcctgcgtcctatcctgatgacggtgctgacgatgatcttcggtatgcttccgctgatgttctcttccggtgcgggtgccaatggtaacagttcgctgggtacgggtgtcgtaggcggtatggctgtcggaacggtggcattgctctttgtcgttccggtcttctacatcatctttgaatacttgcaggagaaaatccgcaaaccgatggaggaagaagcagatgtacaagtgcttttggagaaagagaaaagtgaagctgaacgtgaacgttaataaataaaagaaagaatgaagaaaaatatcatcctgttagttgccatgagtctgacgctgagcggttgtggcatctataccaaatacaagcccgccacttccgtccccgacgatctttacggcggggaagtggtgacggaagacactgccggtctggggaatatggactggcgggaactcttcaccgaccctcatctgcagtccctcatcgagacagggttgcggaccaataccgactaccagtccgcccagctttgtgtagaagaagctcaggcagtgctgatgtccgccaaacttgctttcctgcccgcctttgcgctttccccgcaggggacagtgagcagcttcgatacgaacaaagctacgcagggttattcgctacccgttaccgccagttgggaactggacgtattcggccgtatgcgcaactccaagaagcaggcgaaagcgctgtatgcacaaagtgaagattaccgtcaagcagtccgcacgcagctgatagccggtatagccaatacttattacacgctgctgatgctggacgaacagctcatcatctcccgacagacggaggaggcatggaaagaaaccgtagcctctacccgttccctgatgaacgccggactggcgaacgaatcggctgtatcgcagatggaagcgacttattatcaggtacagggttctgtgctcgatttgcagcagcagatcaatcaggtggagaacagtcttgctttattattggcagagacgccccgcaactacgaacgcggaacgttggcagaccaacagtttcctacggactttgccgtaggaatccctgtccggatgcttgccgcccgccccgatgtccgctcggccgagcggacgctggaagcagcgttctatggcaccaatgcggcacgttcggctttctacccttccatcacgttgagcggaagtgccggatggacgaactccgtcgggtctatgattctcaatccgggcaagttcctggcatcggcggtaggttcgctcacgcagccgctctttaataaaggacaggtggtggctcagtatcgtatcgcccgtgcgcaacaggaagaagcagctctcggctttcagcaaacattgctcaacgctggcagcgaagtgaatgatgcgctgactgcctatcagaccagtcaggggaaaaggctgttgctggacaagcaggtcacttccctgcaaacggccctgcgaagtacttccctgctgatggaacatacgaatacaacctatctggaagtacttaccgcccgacagtcattgctcagcgcacaactgtcacaaacggccaatcattttaccgagatacaaagtttaattaacctataccgtgctttagggggaggtcaggaataaagaatatcatacttcctctgttttttttgatcctaatgaagaagggctgccggagaagtgattctctgacagcccgtttttcgttagaggcattcccgatttgaatcaataacagaccaggaacggaaaatacattcctaatgtgcattatagcctgtatgttattcataaacagaaaacatattgcaaaccgaattggccaaatgccgcaacccttctccgccgggcaactgaaataaagtcatacaccaattatcgtttccttccaacatataaggaccggtttcggttatcgcaacatcccatccgatacttctcactttcggaattctcatagcagcttgtttggctaatgctattgcctgatcgtaatatgggattatgcaacctgttattttttcaccactgacaggatgtatatgaaaccgttctcctgacggatgttttattatagcaggttgacagacgacaccccgatgatcaacaaggacggcaattcctcctgtagcaaagttgtctgtgcgagcctttattcctatacgtaaaacaacactccacacatcgaccttatttatactttcatcataatatgtcacaattctcaatgtgttgagacttgacggattcagtttattcagggcgctatgttggataatacgttcttcgtacaaatattcatccggtttttttacagtagaaataacatagtcatgtagttgtcgcaatgatgtaaagttttgcatcggaaaaataatcccttgaccggcttgtccttttatgggtttaatgacgacctcatttatggatatggagtaaggatcatgcatttgcctttttatctcatcaaacgtcattacccggcgccctaggatatcctcaaaaacttcggaaaaacgcactttatcttttaacactaacgcttcgcagggatcgtttacttgacgtgtcaattcatgacgtaacgaagaagtgagatactgtcggcattctgttctgcttttcttaaagaactgcaactcgtagtagttttcgaatgatgcaccatacatccaactatgtgacaatagctcaaggaacatcagtttcctttttccgaatacgtaatgattatattctctcagctttcgaaaatctgcaattcgtatatggtacaataaatttcttatctttgactttaacttgaaagcattattactgctttttgtaattgaacgggcaggaactccggcaacagtagtatggctgtcgatatttcgcgtcactacagcgcctgcacctattttgcagtcagcaccgacaatgacatcaggaagtattaccgcattagcacctatctccgtcctgtcaccgataatggcacgtcccaagacttttgcaccgggagatacttcacaatatcgtccaatacggacgtcatgactgataacagtgcttttattgataaatgtcccctgccctatacttacattacaagtaatagttgcccccgaaagaattacaacacctggttcgatagtattgtcatacccgcccacaagggctttttgggagataaaagtggtcaatactcctccaagacaggcaatctttcgtgccagtacctctctacgctgtccacctccgacaccaataataaccttactgtctgttttcagatgttgctccagttcattccaggatttaataatgggaaagtcataatatgcatcgctaatatctgtatttatattgtcaaacaaagatacagtttcttctacattatcccacttgagtgctgtcaaaatctccttagcacatcctttactcccgattattaccattttacacttttctattttcgacgatattcagccaagaccatgtcaatttgattaatttcatcatcttttaaatccacgtgcaccggcagacaaagcatcttctcagcattcatccctattttgtaatagagcggctttctaaaaatgacactacaaaataaaaccatttatagcgaataaacactatcaaaaagtacgataatatcctcctttcatacagcactgatatttctttttagaaatttcatatctcagcttgataacagtctattaattgctttggaatatattgaaattgttactgcctaataaaccgactgatatgacaatatacgaatagttcataataacagaattatggaggtttgtatgttatatgcggataaagtgaaatgtctttctataaggtgaaagcgatgaaagcggaaaaatggggcaaaagcagaaaaggttcgccctatattactttatatatcggcacttatgatagtaaaataaaccaataataaaaacaataatagtgggaagtatatgtgattaacaatgcttcttagatctcgtttcaagcattattagatgtcacagcaagcattgttaaccagcttctcaagtattaatacctaacttctcagatattaatacctatcatatcaaatgttaatacctgactactcatgtgttaacatctgagcgcagctatgattctttcgcaagcctgtccgtcaccgtaagggttatgtgtttcggacatccgcttatacatttctttatcaaggagcagggcagtgacattactgacaattgcctccgcattcgtgccgaccagcttcaccgtacccgcctcaacagcttccggacgctcggtcgtatcccgcatcaccaacacgggtttgcccaatgaaggggcttcttcctgcacaccgccgctatccgtcagcaacagagtagaatgttgcatggcatagatgaaaggcaggtaatccagaggagagatcagatagacattgctcagaccggaaagcagttcatacactggcttctgcacattaggattcagatgaacgggatagactatgtccatctccgggtgaagagccgccagttctttgatcgctttgcagatatgcaggaaaccatctccgaagttctcgcgacgatgtccggtgacgaggatatactcacgatcacctaccgtgtagcctttctcctgaagttccttcgccatcttttctttcacaccggcggtggtggaaatgatatcgaccgccatcagcagggcatcgatcaccgtatttccggtaataaagattttcttcgcgtctatattctcttgcagtagatttacctttgactgttccgtcggtgcaaagtagtaagtgcagatacggtctgtcacctgacggttcatttcttccggccagggagacaacatattataggtacgcaatccggcttccacgtgtcccacaggtatctgcatatagaatgccgcaagggatgccgccatcgaggtagtcgtatctccatgcaccaatacggtgtcgggacggaagtccttcagcacttcgcgcagtccaaggagtactttagcggtaatgtcatacaagtcctgattgggagccatgatattcaggtcatattcgggagtgatgccgaacacttccaatacctgatccaacatctgccgatgctgtgccgtaacgcagacacgtgtctcaaaatgttccgtatctttctggagcgcctttacaagcggagccatctttatcgcttcgggacgggtaccgaaaacgagcaatatctttttcatctgctttatttatagagtctatataacctcttcgcaattaaactacatttttatcgtctcacaccgcagaagtccagttctatctttccttcctccctgggcaatgcaaggaagacatcgtggcgaaccagccagacgataatatccgctttctcgtatgcttcccgatagtctgtcagatggaagctcttatgagtgcttatattaggttcgataatcagcacgtccgctctcgattcggagatgatgcgggaggcgatatatttggcgggagattcccgtaagtcatcgatattcggtttgaaagccagtcccatgcaggcaacgaccggttcgcgctcgttctgttctacaaacttctggcaggtttccaatactttgttcgcacaccagtccgctttgtaatcgttcgtttcacgggcacgcttgatgagctgcgcctgttccggatagtcggatacgatgaaccaagggtctaccgcaatgcagtgaccgcctactccgcagcccggttgaaggatattcacacgcggatgcttgttggccagttcgatcagttcccatacattgattccggctttgtcgcagatcatggagagttcgttggcaaaggcgatctgtgagtcgcgggaggaattctccgtcagtttgcacatctctgccgtgcgggcattggtgccgtgcagtttgccttgtacgaaagcggaataaaactcaatggcttttgcggtggatgccggatcgatgccgcctatcacgcggtcgttgtgcaccagttcgtataatgtatttcccggcaatacgcgttcgggacaataagcgatatgtatcttccctttcagttcgggacgttctttatagatcacttccgccatacgttcggtggtatataccggagaagtggattcaatgacaaacaggttaccctcctgcagataagggatcacggaacgggtggccgcttccacataggtgatgtccgcccgatggttctgcttgaatggggtaggcactacgataaagaaagcatccgccgcttccggcttgcatacagcgcgtaactttccactctgcactacgtccctgactacctgacccagttcaggttctacaatatgtatctttccctggttgatcgtttccaccacagaaggattgacatctactcctatgacttcgaaaccgtgagcggcagcaacggctgccgtaggaaggccgatataccctaatcctaaaaacacaacctttttcatgttcaatatctccttattaataagtgtggcaaaagtacaaataatatgtgactttgtacggattttcactgaaaaccactacttttgtgcaaacattttgaaagcatgagggtactaatcatcaatacttccgaacgaataggtggtgcggctgtcgctgccggacgactgatggaatcgcttaagaacaacggcatcaaggcgaaaatgttggtacgtgacaaacaaacagaccaaatcagcgtcgtcggactaaagggcagctggctgcacgtatggaaattcatgtgggaacgcatcgtcatctggaaagccaaccgtttcaagaagaatgatctcttcgccgtagatatcgccaataccggtacggacatcacttcgcttcccgaatttcagcaggcagatgtcatccatctgcactggatcaaccaagggatgctgtcgctcaacaccatccgcaagattctgacttccggcaaacctgtagtatggaccatgcacgatatgtggccctgcaccggcatctgccattatgcacgcgaatgcaagaattacgaacaggaatgtcaccactgcccttacatctacggaggaggaggcaagaaggacttatctacccgaatcttccggaagaaaaaagagatttatagtcaggcatccatcacgtttgtaggctgtagccgctggctggcggaaaaggccaaagtcagcgggttgctcaccggacaaacggttatcagtatcccgaacgccatcaacacgaatctgttcaagcctcacaataagcaggaagcccgcagaaaatgcaggctgccgcaggaagggaagctgattcttttcggttctgtcaagatcacagacaagcgaaagggcatcgactatctgattgaagcctgcaaactgctggcagagaaacatccggaatggaaagaatcattgggcgtggttgttttcggcaaccagtcgcagcagttgcaagacctgattcctttccgcgtctatccgcttccttatattaagaatgagcatgagttggtggatatatacaatgccgtagacctcttcgccatcccttctctcgaagagaatctgccgaatatggtgatggaagcaatgtcctgcggtgtgccctgcgtcggtttcaacaccggaggcataccagaaatgatcgatcatctgcacaacggatacgtagctcagcgcaagtcttccgaagatctagccaacggcatccattgggtactgacggaacccgaatatgcggaactctccgcacaagcctgccgcaaggccataggcaactattcggaaagtatcatagcgaagaagtacacggaagtttacaacaaaataacagggaaatatgcatagtgtccatcctactcccaagttctcgattatcacggtgacctacaatgccgagaaagtactggaagataccatccaaagtgttatctcgcagacttatcaccacgtagaatacatcatcgtggacggggcctccaaagacggtactctctctatcattgacagataccgtccacggataactaccgtcgtcagcgaaccggacaaaggattgtacgatgccatgaacaaggcgatctcccttgccagcggcgactatctctgttttctgaatgcgggcgactgctttcacgaagacgatactttgcagcaaatggtgcacagcattcatgggagtgttctccccgacgtcatctacggggaaactgcgattgttgacaaagacaggcactttctgcatatgcgccggctttcagcgcccgaaaagctggactggaagagtttcaaacagggaatgttagtctgccatcaggctttctttgccagacatacgctggtggaaccttatgacttaagctaccggtactctgctgatttcgactggtgcatccgcatcatgaaaaaggcgtgtaccctgcacaatacgcacctgacaatcatcgactatctggatgaaggaatgactactcagaaccgaaaggcttctcttaaagaacggttccgcattatggcaaaacattatggatggataagcaccgcagcacatcatgcttggtttgtactgcggttgattatcaagccgggacaataactgccacttaaaatcagtatagtcacttcacccacaaaactcctatttatatattacctattgaaaccaattatatgcaggcttatctgttaattcgaataaaatctccccaccgttaataatatctgaatgagttatgacagaactacggtgaggcttgccattgagatatacagcgcgtacataacaattgcctttgccgaaattctttgttttaattgtgaatgttctattttgaggcaaatgcaatacaaagcccggcagacagggaactcctaactgatattcaatagaagccggacacatgggatagaatcccatcgcactgaagatataccatgaacttaattgtccacagtcgtcatttcccggcagtccgctaggtgtgggcagatagtatttattgactatatcatatattcttttttgagtcatccacggtcttttacagagattatacatatagggagcatgcatcacaaattcgtcacccacatagtaaatatctttatcgaatagttcatccataaaaacggctaaagaatcggtacctccccaaaagcgaattagttcgggaacatcatggggaacgaacaacgtataattctttttatagttgtacactcctttggggttaaaaccactccatacgctgatatcgtaatcttccggattactccatgaaccatctgctttacgcgcacgaaccattttggtttccttatccagtacgttcctgaaatttttgcttcgtttacctagtttatccgataagtccggttcacctttttcggcaaagaaacgggagagacaataatcatcataggcaaactccatcgttctggctactgattctccatatttatcaacaggtacatatcccaatcgttcgtagtccataatgcccaagcgtccccaagcaatgtggttacccttttcatacgcatttttcagcactgcttttttagctttctctacatcaaagttacgcactccttttacataagcatccgctattatggcatcactatgagttcccatcatgcagttggtatatcccggattaggccatttgggaagccagcctccctcatcgtaggcatggaggagtccggttatgagatctcccgcaaaatcgggtttcagtaatacgaacagaggatgggtcgctctgaatgtgtcccatatagaatagtctgtaaagctaatacccttatgtacttttccatcaaacggacttctgtattttccatcttcagatagacttctgggcaacaggaaagagtgatatagcgctgtataaaaaacaattttatcttgttctgtagctccgggcaaatcgatgactgataattctttattccataatgcttctgtttgtgcactgattgtttccatacttttggctccgatttctctttccagatttatccgtgcctgttccacactaataaaggatgtgccaacgatggctttaattacttcattttttccggttttaaaacggatatatccccctattttggtagacgattccaaatgtcgattgccagtcagaagggatgttgatgactttttatcaggcctgatccaactcagttttatccgtgagctccattcatgctgataatattccaattttatatcatacattttaccggcttccagagaaatcttcttttgggtaggttgatagctgaaactatgagatttccagtcatcgatgagcaattctccgttgatatataatcgtgctccgtcgtcagcttgtatccctaatgtatattcaccggtagagggagctttgagtttaccgctccaggtcacctggtaatcattaaaactgaaatcatccgcaggtttataccagtcccagtcaaaatcgataaccggatcgattttttcactccgcagatgtccgaccccctttgagtcctgtgtataaatcccttttaagccattgacccacttgccttctttttgagtgaacagatatttctcttcgattacttcgggataatcattattaagattaaacgtgccgaaagagtcgaaatccttatcgaaacggactacaaaatatccggtttcccgatatcctctggcagattgtatgcttttaccggaaatttcttttcgtaccgggtctatgtgaatgtagcccggtgctccggctgtaaacatggaaggcatagcatctaccactacgtaagcactatccgactggggataggtaaattgcaggatagctgaagtttttgtagccgataattgagcttttacctgatagtcgtccaacatgacttcgtagaagtgaggttttgacttttcggttatatgggtaaaagaagaactacgctcttcgggcctgcatttcagttgtccgacaaccggcattagttcaacagcaccataatcgaacatgacggccccacttggatagtgtgttcccataaatcccgaaatatagttatgtttataccagtagggtacccgatggtgcagcgttccagcgtgcttgctctctaaagtatgggcagtccattctgtcatcccgaaaggctctgtcactccgggaaaagtatatcccgaaggatcttcatgcccggcaaccgctactccggattgccatacttctgttccaatcaatgggttgacatactgtacccatgaggctttttcctcttgtgagttcatgttaatcggcgtcaggaatggaagaacggccagtatcaataatttcattttcatggtactgtagtttaatcgttgagtattcttttgtaattggcagctctcatatacatataagccgctacagtagaaaaccttaaatcatatttttcaagattgcttgtcgttggcgttccccagtgttccgggtagcgtccattgccgtcacgtagtttattgtggataaagttaatcgcatggaaagctttcgttagccaaaccgtgtttttatctgtatcatacatatcaaaccaagagtctattattgaaaaagcgaaatatccgggatcattcagagctccgttgattgaattataccatttggcttcggaagatgccagggtagcttttgcctgtgataaatatttttcgtctttggtggcctgatacattttcagccaactcctaatcataaaaccagcattgtatgaccatttctgtgtattaacagaaccatccgctaccattttggcatcccacagaagattgtccgatttatccaaaagattctcaacagtccagtcgtttatgcggatggcagcatccagatattggcggtcctgagtgatttcatagagtttcatacaactcagcatggttacggcagagcaaatcgtattcttctgtacgggtaaagaaacaaaagtttcctggaaataaattcctcctcccagcacattatcttctcccgaaagggaaaaagcgagtgcccctttggctttttccaagtaagaattgttttgagttgccagataagcatcgcagagtccgattgctgtccatccgttttcgtcgtaaaaacggtcgggaaccttctcggcactcgtaggtaaagtggcatatcctgcaatacctttatagttgggatgccagtagttatcaaaattaagaaagcagttcatcaaagcatccgaccattcagacttgctcaatgagattccttcggtgtatgtataaagaaggaaaatatttccccaaataaaagagacttgtgaacggtcctgattctcataataagaatgtgtaccacttattttcaaatctttatcaatgacagatagtgtctctttacaccatgtataataatcattattaccgatttctacaccgggatcggtgtcaatgatgatatcctgtacagtggcatcacagcccgaagtaacctgtacaaaggacaacatagccaaaagtgtttttattttattgctgattcgtatcatagcagtcagtatttataaagtttaattaagattatcaagatcagaccatgttaagttgaccaaagtagccggatatttacctgtaatatctttaatagaggaaccgcttttcacattcagttgccagttggcaaccaatccttcttcgtccccttttaagaaaatctgatagttgtcggcaatctgttgttgagtacgaatcgtatgccagattcttacatcataaattttacctctgaactgacgcccgttccaagtagaaagatcgccaataatgaatttacaactaccttcgggaatgtacggcgcaatatccatagttgcggcttcttgcccgtttaagtatacctttgcggtttgcgagtcgaatgtagcggcaatatgtacccattttttcaattcaatagagttctcctgagtaatgcagcttgaccatgtaccgttgacaatcgtaaagtcaatcgcattattcaccccttctgccagacgaatcagcaaaccgtagatgccgttatcgcccgaaccttctgaaccgattatgctgcctcctgttttctcattggcatacacccatgcctccagtgtcaacttatcagagaaaaattgagaagcagggccgcagtcgatataacctgttccgtcgaacaacggacatgctggtagcactttgcttgacaggaatgtttgtcgggcaatctccagcttttcgcaatagttgtcgagagctgactggcgatcagttttattccggataaattctgtttcccggatcttactttcgaaaatagctttcgaaccggttacgaaatcacccaaatcttctccttcagaggaagaagataaaagttcattgcattgagaaagcaaaccgtctatcttattatattcaagtgtcacttctttttcatcggaacaagcagccgccagtaggatgaaagcaaaacaagctaaatgaaatatctttttcatggtttttctttttaatcgtttacaatttatttggtgtatcccggattctgtttcagctcaggattgagtttggttgcctgcaggggaatcggaaaaagattgattgtttccttatctgtataattcttatcccacatcggttgaatgaaacgtccgaagcgaatcatatccgttcttcgcaaagtctcgtagcacatttctcttcccttttctctgtataactcatccaaagtcagttctccggttgcatacgtagaaacacctgcacgtgtccgtatcttgtttataccttccagcgccttagaatccacctcattcgatttacgaagagtggcttctgccagattgaagttgatttctgcaatccggaacagagcaaaatcattttccatgccttgtgcaccgacttttactttatatttaatattacgtgcaccggcattctccttgttgtttaccatgtccggcaagtcgagggtgaaatccaactgttgtccggcatattcattggttcccaaaatcgggtttccgcttaaatcgaattgggggccccacataaattgtccgtacattccgttttgaggatcatacttacaacggcggtcgtgagtaatatcatacgtttcaataaactctcttacggtacagactccattccatcccccattcggattcttccaatcccattgcgaacgctgcgaccagtgaatgttccggtagaaaaggacactcatctcattggcaactatttcgtcattagggatcacccagatattttccttgctattctcattgttccatgcaaagggagcatcccaagtagattccagctgataacctttttgaagaagagtctgtgacacagaaatacaatcgtccagacgggatgttccggtataaacttcagcattgaggtaaagtcgggataatagcgctaatgcggcttcctgagtaaagcgtccgtagctgccggtatctgtacttctcagaagctggtccttgacttccgcaatttctttttccacgtagttaaaaacctcagttctggttttagttggcggatttagttcggataccttttctacaatcggaacatttccgaacatatcgaccagcatggaatagaaaaatgccctcaatgcccgggactcggcaatatatagctttttcttgttctctggaagaatatcggaacgggaattattcaaatcattcagcacctgattgcagaaacccaccgctttgaacagttcctgccatgctccgttgataatgacatcctggtcggtccatgtgtgccaatgcatacgttggtagatacctccgtcataaccgtctcgccctttttgaggtaaacaagcttcgtctgtagtaatctcttgcagataaaatacattccaagcatacatcgtacgtaagaaagcgtattgattcataaacgccgcatcatattcctgttctgtctgataataattatctttacccaaatcattatacatattttcggataagtcgacgcaaccaaccagaaaaagcaatgttataaaatagataatctttttcatgtgaatcaaaatttaatgtttaaacctagcataagagttgtagaacgcggatagtaaccggaatcatcgaatccgggcgtgagccctgtacctacttccggatcaactcctgtatatccggttatggtcagcaaattggtggcggtggcataaatccgggcatttgacacatatttcaattgggacaaatcgaacgtataccctacagttatgttgtctaacttcaaataattacctttctccagataataatcagaaaaagtggcagcgtcattcaaaggtctgcccaatgcggatttcaatagattgaaaggtaaagacaccgagttctcgtaataaatccgtttggtattcaggaccttaaatccggctgcaccccgaagttggaaagagaaatcaaaatctttccaggtcaatgtactggccagattgaaataccattttggaagtccgttgcccaaataagtgtagtctttatccgaataagcaccgtcctcatccctgtcctcaaatacccatttaccggcactgttgaaacctctgtattttaatccgtagtacgtaccaatgggtttgccttcttccagtatatacgtagtctgaccgttggcaggtgaagaaagaggattgtaagtgatgtgattggcacggtaagaactgtttgccaaggagaccaatttattctcattgtatgagaatcctccgtcaagatgccatttcagttctttgttgcgaattacatcatacccgatagcaaattcaataccttgattggtcagtgtacctacattggtaaatatcgtactgtatatatttgaaggcatttgcgcatcataccaatccagcagatcagtggttttacgataatagtaatctacacttgccgtcagcctgtcgttccatattccgaaatcgacacctgcgttgtattcagcgttcttctcccatttcaagtcgggattcgggttgctgacaggaccataaactttgtcccattttccattatagtaagcatatccgagatcattgtatttggctatggaagcatataaaggaatatcctgatttccggtgataccaaagcctacacgtagtttgaggttgctaagcggggtagcatcactaaagaaattttcttccaatattctccatccggcagagacagcaggaaaccagccccatttatgattctctccaaagcgggtagaaccttcgcgtctgacactcgcattgaacagatatttacctttatatgaatagttgatacgaccgaagaaagctattaactttgattcatcctgtccccttcccattgaggcaagtccatcttccagatacgtaccattaccaatattgttagctcccggaatatctgtcaggaatcctgagttggacgcattgtgccaggttctgtcttctctgttgaatgaataaccggcaagagctgtcagattatgtacatcagtggagaaactgtaattggcataggcttcaaatgttcgtttcttgtagaaataagtattcatatctgcctgcccttcaaagcctcctaatacactgtagcgagaatcacggctgatatatttggaaccttcgtaggtatcgttgttggcagacatcatagcatatacactcagacaaggcaatactttgagattagcagacagattgccggagtaggtataacgttctcctctgttatctacttgcgaaagtaaggctaccggattataaggtcctactcctgcgtattcgaagaattttccttcctgattataaacaggtgccgtgggatgatatacgatagcttgcatgaaagctccgtaatcagtataatccgattgagtgtttgctccgttcaacgtaccttctatagtcagcttcttgtcgaaaaaatactgcttgaagtttactctccccgtcagttgcttattgccagtgttgattaccatactttcagaatcccggtaaccgacagagcctcgtatggatgagttctccgttcctgttgagaaagaaactccctggtaataactgaaattatttcggatcagctgatccgtccagtcggttgagaagccgtaatcgttgttgatggtggagtgccctttgtctttcaaatatcccatatattcatcggcagacatcatttccagtttccgcaccggtctttctgtgtaataataactggtatattcgatactggctttgcctttagacgcatttttggtttctacgatgataaccccattactgcctcgtgtaccgtaaatagcggcagacgaaccatctttcagaacattaaaggacttgatatcattagcgttgattgcctgcaactcggacatggtactgtaagttccgtcgacaattatcagcggagcacttcctgcccggatagatccgatacctcttaaatgtatctccggtgatgcgttcgggtcatttccgcttgtattgcgaatggataatcccggtactttgccgttcagcaagttaatcggactggtagttacccccgcattaaacgattcttcccctactttagtgacagcactggtcaactcctcttttttcactgtaccatagccaatggctaccacctcttccagttgtacgctgttttcacgcataacgatgttcagcctattttgtgtcaccgttactttttgcgtctccatcccgatatatgtaagaacaagcaccgtatttttagggatgtcagcgagcgtaaagtttccgtttatatcagtagtagtacccatatttttgttctctaccttgatagatactccaatcagaggttcaccagaggagtctacgacctttccggttacgttcagattttctacaccgtaaagcgaaggaacacatacacacaggaaacctgccattaaaatgcaatattttatggttctcagcgtcacctgttcttttattcgttcaaaaaatgaaatggctaaattctccataagttagactttttgaataacataataattaagtcaatataaatagttaagtatagtcgttagagggcaatcaccaccactcctccgatgagacataccaatcctatcaccatcatccggatggcatagcgggtagctcctttccactcgccggaagcaagtccggccacattacctgcaataatagctgtcgattgcatggtagcccagcccacagaagctcctaaaactcccataaaactgcctcccataccatagaacataatgctcagataccataatacccctgccagagaagccattatcaggcctccggttgtacgatgtcggtaagttttccaagattgattcttgccgaacaaacggatacattcaaggagattaataataaatccggcactcaaagcgatactccatatcacgttggctgcataaagagaagatgctcccgttgctacagccttttcttgtaagggtgccccataaacgaaagcaaagttaatcataggtccgaatattcctgcaagcaaacagataattaaccctttcctgaaatttttcttaataggtgtttcagagtgcgtctggcggcttttgctatctctgttgtgccctgctatcgcaaagaaaatgattccggcaagaataattactgtacctgtaagtaactttagtcccgtaggtgttagcaattccgaagggtttctgagaatgacaggcatcaaagtccctaccacattaatcaatccttgcataatgggaagactgagcgaaactcccagataatcaattccttttccgaatagtatagcgccaattccccataaaaggccgaagaaagccactagcagtaccgtgttgctttcatgagcatatacactttccaagtcaggaatagagataaatgccattatccagggagcgacaagaagagcgatgatactccagataaaccaattgttttcccatttccactgtgagttgtgtttaaaaggcaaagcaaacgtgccggaacaaccaccagccagcagaattaataagaaacccgaaataactgtagtttccatacttgttttaattttcggtgagtgaaacgattttagttacgcattcccgcagttgggacttttgagactctgttaattcgaaaaattcaaaatcattcagatgggtgtcgttattctctatgatgagtacctggctccccggttgcatggcgatcttgtgccatacttctcttcggatattgtacactatacccggttgcatatttactacatcataggtaatattttgatcggtgacagaagcaccgatcaaagctgcttttccctgcaacagtataaatacttcatctgtctgatggtggatatccagtttctcaatttgctccagagattcggcctccgcataattgagataggctacctgccacctgtcggttatcaggaacgggtgatatccctttccttcaaatgtgtgttcatcaatgattttcatgatataagatttttagagtgaatatgatttagctttctaagatacggtctactaccaattgtctgaattgaggggacaacatggaaaagtaggctgtaaatccggtaacacggactaccagttccggatatccggcaggatctttatgggcagccaatacagtatccttattcataatattgacgttaatcaaagtacctcccaagtcgaagtgtgccctgatgatggacatgattaactctatattatccatattggcgaatgtagggtccagctcccattgcatgggtgccgtattgccatatcccggctgaattttagctataatggtagcaagtgaaagcgatgcgccgtcttttacaaaaccgggagtgggatttgctccatgagagataggtgtttgcgctaaacgtccgtcgggagtagctcccacactttgtccgaatcctaccgtatttgcccaagagaagaagccgggaataaaaatccggcgtttgtccggttcggactgcaaacgtaccagttctgtaaatgtttctttgatccgaatcgcccacttttcgcccaaggattcggtggctccatatttttcgctgttcttcaataaatgccgtattctgcatcctccgtctcctgagaaattgtttctcagatattcggtcagggtattccaggacaatttgttttccaactcgatgcgctgttccaaagcggcaaaagagtcagcgacagtagccaatccggctccgtcaattgccaggttgtagtattccgctccaccgtccgatacgtctttgcctttttccaatggcccgtggctcaatagatttagtaataactccggctcattgtatttttgaaatttcaggtgatggcgaattccgtcggctgatgtttggactgccttagccaaatgctcgttgaataacatccagagccgggaggtgctatgatctttttgttcattcatcatttccgtataggatacctcaaaaactttcgccatatttattttcacaaggtcattcattgtatattccagtccgggcagcgacatccagttgcatcccactgctatacgacggcgagccagttgtgcactgaagccgttcttcataaatccttctaccaatgctttatctcctgagaatctgggccatccattcttgttcttaaccaggtactctacggatttccggaataagtccttgttcagaccatcgaacactctcactgtcagatttaaagaggtattgattttatcggcagcttccagtattaagaatgaaaggggggaagtttggtctttacctgattcgtcgggacctcccaattgccagtagacagggtcgttcagtaaaaaacacgccaaataataaacggccgtttctttatcaatccttccttctgccaaatctttttcataaaaaggagccaataaagtatcaatttgtccgccagctccatcacggttgtaagttcttgatgcaagatgataccatatgatccactgacaggcttctcttaatgtcgttggggcatcattgataatgctctcgtttactttggctatttccagtaagttgtttttagaacaatcgtctgttgcagatgcagccattctatatgcctggtcgatatgacgctgtatccacccctgcacactacgtatgacccttagatgcaagctgtagaagtgttgttgctcttctgaatgatgcatggattggtaatgttctatcttctttatcaagccattccatcctaattttaccccgatttcataatcaggagcgaaatgagcgtcatcgccaataccacaaatgaggtcatacttcttgatattctcttttagaaagtcataagaataatccggattccatttattgggtcgcattttagacatgaaatacatccatcttcctgcaaaagcatcatcggcatcaatatataccggatgaatattcatcaggctgcaaaagttatcagcccatgcatcaaatccgtagaaagaaccatcgggatggttaggtatgatattccacaaattttccggaggaaccacccgtccatagtcatcttcgtccagaagtccttccttttcaatcttttcctgagtttgagcgagtttccgcatacgcagattcgctattttttgctcgtaattcttcattttttgttattgtttaaattatatctgatcagtatttcctttagtttttgtaattgtcctttctttaaaaaagcagaattgcttaagggattcttcattcctaaattctcgaacttaacgaatcccaatgaatgaaatcccagcaattcataagcaggctgattaggtaattgccgaatgaagcggcatattgactcgatagcttcttcggaatcattgacgttgggaatgaccggtgtacgaatggtcaaaggaacagcttgtttggctagaaattccaggttctttataataggaacattggagtgtccggtccatttccggtgtaatgtgtcatcggccattttaaaatcgcacatccataaatcaacccaaggaaggaatgcctccaacgtgttaacatcagtcaacagattggtttctacagctgtgtgtattctatgttcccggcatttttggagaatatctaacgcaaaatctttttgctgcaaaggttcaccccctgagagggtaattcctcctccggatttctgatagtaaataaggtcctggagaatttcatgtatgatgtccgaagaatcaacttctttcccaatccaggacagtgcgcccgaagtgcagcgctctgtgcatttcccacaatcagtacaccgttcgcgatgaatggataatctgtttgagtcgatgaacagaacttcatactcacataccgttatacaagagaaacaatggatacatttgtcttcaatatactggagttgcggtttcatgctccaggtttcagggttatgacaccacttacatctcagattgcatccttttaagaagatggtagaacgaattcccggaccgtcatggatagacattcgttggatgttagttataaagcctttcatgatatgattcttttagtattagctgatggggacaaaggtagaggttgtccatatacgtttttccgatagaaattattcatagcggtagtttttttacgctattccgactttttatgctttgacatataaaaaagagtcttcacgggttgtgtttgtgaaggctaactcttaatattgcaatcaaatcaaaaaagaatatgagagattccgtttttaagctatcctattttctgagtgcaaatgaaaagtttcatattgcaagagtgaatataacctcttctcaggacttgtccttacattcacatgactatgctgaaatcttatgggttgaaaagggaacaggcattcaccatgtcaatggacatcagtttagactatctccgggagatttaattatggtacgtcccaaagacaggcatacgttttcctcttcgggaaaagggatcgttattgtgaatgtggcttttcccgtggagactttagattatttccgtcagcgatattttgaatggagtaacttgtacttttggactaccggtatgttcccatttcagatgagattatcaagggatattgtgaaaagactatcttcgcgggcggaagaagcaatgaaatacgggcgatccaatatacagctcgatagtctgttgcttttcattttccggcagattacagctaatgaaaaggtggaagattcttcagagataccggtttggctattcaatgctattcaaaaattcaatagtccggaattttttattcagggaattgcggggttcgtcactttatgtgaccgtaatatcgattatgtgaataggatcgtgaaactgcactttcataaatctctgactgatttaataaatgagtttaaaatgcaatatgccactactcagctatctattaccagtatgccgatcaaggagatatgtacaaattgtggatttaggaatctggggcatttctataagatattccgttctgtatataatcagactccttacgaatacaggagaatcaatcaattaatcgtataaagctgactgcttccaacagatattggggacacttgagctgtaatgtgagttaaaagaaaaaattctttgctgaaatgctcctgccaacggcaaatgcttgtaatgtccaaggggtaagcaaagagaggaagaatctcctcttactgtacaagagagaagagatccttcactgcgttcccttagatatctttccgaatgacagaaacttcaaatacctgaactgttacgattcacctcataaagcattacctgatccagtatcactccctcatccaatgccttgatgaccagttgatgtgatttcttacccgtaacgggaagtacgattttccggattgcctgattacgaagcacgttctctttccattcctcgctgcgtcccttcgtttcgtaagctatcacttcaggctcggcaccatccagagaaaccgtgaaacgcaacttatcgccatgcaccggatggttgggaagtaaccggatatccacctctaccgagtccgttttcagattgccaaaggagaaagtcagcgcatcgcctttttttatctctgcggctttgctttcatatcccaaaccttcgcagacaatagcgtttcccttctttgcctccgccgcgttccattgacagactgctttacggtccgctgtcatcggagcagtagccgcctttctttccacacggttgaatacagggagcttgcggggtttgaagtccatcatgcgattccattttccattctccaatgagttatagtgttgagtcagtgcagcaatgctgtcgtaagcggcatcactcttttcccagtcttccttatcgtggcgtgccaattgggcgtataacagtttgcgattcatttgtgtcgcagcctgtacgggatatttcaccagttcgaagtaagcactctgcctaccggcaggtactttagaagcagctttctctactgtttccgaaagttcgctgtaagcattcagacgttcgtttatctctctttcgctccacggtaagtctttgactacccgatagaccggattcttttcttcctcccgtgtatttcccataaattcgggtttgcggatatgtgccaagcgataatgttcctgcataacggagaggatggtctttgcacaagaggttcccagttcccgttccagccaatgtttcagatgtgcggtcactccttcggaagataccttatccagattccatgccatatccatgaacagttctatctgatactcggcaggcttgatgtcgccgacgttcagtatccacattttctgtattccctgatcgtaagcctgcttcatctgttgataaatgagtgatggactcatggtgctcaaccataaatgatcgtgcgggcgtccccagtaggaaacatgataatagactccgttgccgcctttacgggcacgctcttcggcagtggggaaatggcggatatagccgtagttatcatcacaccacatcaaggtcacgtcttcgggtacttgcagccccgcatgataaatatcgagcacttccttataaggaataaagacctgcggcacttgtgttacgtctttattcacgtacttttcgagcaagccgcgctggtcaacaaatacccggtccaggacggctttctgctcttctaccgtcttggctccctgcatctttccatcgtgaacgccacgcatacccagcgtgtaaagtatctcttgtccggcaacttctttcacacgatcttcccaaaactgataaacggccggactgttattcacgtaatcgtatgctccttttccacgtattttccattctccggcagcattgcacgccatcggttcgcagtgggaagctcccataaagatgccatactttttcgctgcttcccgattgcccttcgtcagaaagaaaggaagggtacactcgtgcatggcaggccagtaggtattggcccgcaaacgaagcagcaactcaaaaatacgttcgttggtacgcggcccgatttctcctttcacatccgacggttcgtaggtcttgttactccaaggcatcagtccccaatcttcatcattaataaagatgccccgatactccacagaaggagactgcaactctctaaacttgcccgaaagacgaaatgtctctttcttctccggagtcacatctgcccaccattcccaaggggaaacgcccagcagacgggatatttcaagtatgccgtaggctgtaccgtgactgtcgctgccggctactactagctttccatcttctgagacggcgagcatgaaagcctgctttttgttttttaatgcggaaatatcgatgcctgcctgctcaatcagcttgctctgtccgatcgttcctactatgatgtttccggtgtttgtgtctatatgggcagttgccgacaatacagtctgaaggtcacgggacaacaagtccagcgaagtacgcaccaccggtgcttccgaaccgctgcaagctatcgcaaccggctgaccggactgcaaaacaaaatctttttgtttaccctgaacggacacgatcactgctacccaagcaaggaaagaaaataaaattctatttctcataaatattacagttttacaatatcagtaatggtcacaaagcaatcgtcgctgccatagattctcttcgttttatcagtccatgtggggctgatgcccgtaacttcaatcaccagcgtatattccccttcagccaattggggagtcttaaaacgcgttgcatgatcattcgccttactatagaaatcgaccagtgaagaatatattttctcccctttcttatcaaggatattcatacgcgcatatccgctatgacagttcgtttcgcccataacagccacacaagagccagtgaaaggaatgctcagcgtacttccttttacattggaagatattcttccttcctccactttccagtcagcttctttactgaacgttatcttctttaaatcgacggtttttcctttgcgcagaggatttacgggtttcaacttatcaacgtcccaggaaggccagtattccggaatagaaagctttgttccatccacctgcataggcatccacacataggtggcagccgaagcctgatgcggataagaccagcgatcgcccataaacataggaatcgtatcttcaccacactttaaaggaaacacaaaagtggtctgtgaattataggtcaggcttccttcgggagcaaacaaaccttgtctggtccacggccctttgacggaaggggctgtaaagtagaaattatcattcttctcccaactggtcagattggagaacaagaagaaatacgtgccgtcctttttaaacattgccggagactctccgtgagaaccacctactcccgataccactttttcctctgccgtacggtagtccttactcaaacgatagacaattcctccgtgcaacagcagatatccggtaccgtccgtgtcctgataagtccccatatcccagcggcgaataggcttaccttcatacaacagaggtccgtgaagtttatattcacctgctatagtgctacaggtagcataaccgatatggggatctttatagttcatatcgtctgcatgcatatacatcacatactcgccggtagaagggcatttcatgactttcacacgctcgcctacacgatcagggccaagaattccgcttgactgcatcggcagtacaacacgttcgaacttccagttcaccaaatcatcagatgaataacaactgaaacccggaaaagcattgctcttgtccgacttatattccccgaaaagataatatctgccattctcttccacaatgcaggcaccgtgggcattgactatctctcccctgtcgtcaaaccagggaattccgttatttactactttttccgttttccgggccatgcccgttccgtaagatacccacaaaagggcaaacaataacatccagtatttcatgatattcttctataaatgcttataaaaagtataaggcacaattaaattacaaatttacgattaactatctatattcctatggagaatagtacaacaagcatggaatattgtactatttttcttcaaaacaacatcccgcagaacagccacgcactttccatctccgtcgtgcatatcatgcagcatctttcatcattgataaaaataagaatatttaatgcacaaaaatagggagaagaacgcaatgagacgggaggtaaatcgggcagatatagggggcaaatcgggcaataaagtaaaagattgtcatgttacgataattcgcagtctgctaagtcaaataaaagaaaactctctacgggttcttctgacatatagaaaactttttaccatcaatactaaaatcgcagttgagtttataataaatagttgcatcgtttattataaacggtctccccatttattataaactccagtacaccttttaagcacgtatttcttgattttatgcaacaaaaaaggctgcaaaccgtataaaaggttgcagcctcaagcttatcaccggttcacatagatgctgatttgcatatgatcccctttgtattttgttataatgttacactatttttttcggttcggttaagatgattgataaggtgcatttcgtttcattttttaatgggttgttactttattgcctgtatgactcctgcaaatatacaacaaaaaaatgcctttgtcaagtcctgcggatatttgaataattaaaaagcgacaggcagtgcaagtaactgatacatcaaagtgcgtgccatacgctcctgccctttggtgtcgggatgcaaacggtcatagccggcatcatagaaataaataagctgttcttcaaccatcggattcatacctgtcactgcattaaagtctatgacaggtattccccatatatttcctgcctccttaatagcctgcacataagcatctatatattctccgcaaccattctgatagctttcatccggctggacattcttatcgccgaagttagccaacgaacgatgcaaaggagtcagcagaacgatctgcttatccgggaaaagtttcttcagttgagtgattcctatattaatacgacctctataagtgtcttgagtcatgacaggcgtacgctttttccgcgtcaccatcttcttcatctcaccgtgagcagacagcacttgctcttcttgttccgtaaaccactcaccgataggcacactactattataatcgtttgtccccataaaaaccaggatagcatcgacttctccgccatgttctttcttcagcttttccgcctgacggggtacatcatcccactgccttccactaatgccgtaaacaaaaggagtgatccccagccattctttcagaaagtcccagtacttctttatattatcaccgtagcaattcgggtctgtgatggaatctccgatgtatcctactttcttgccttgccagggatgctgaatacaaccttgtttattttcagaaaagtcatttgttacagatgcttgctcttgtccatacgccaaacaagaggagagaaacaaaactgtgcatatgatcagaaacctgtttttcattgttttattctattaataatgaggtactcgtattcaagtatggaaatgcagcctcaaaaatagacagtttaagcgaaagtagcaagaataaaaacaagaagataaagatagtaccttcttcccccgtttgcagggcaactataatctgattgcaggacatatatagccaatgtgcagggtaactatctcctgcacgttggacatatatgtcctgcacgctgggcatatatgccctataaatacttcatatatctaatacacagacttattttgtgtacatcttcaatcggatatatccttccttcgactgatttttcaatgcaatcccgatacgtgtatatgccggagagttcacttcaatcgtttcggaagtaaacgccactttaccggatgcctcaatagctacaatcatctgttcggaatcagtagccagcagaagatgtgtatcgtccaggattttccagtcggctcgtgtcgttatggctgtttcgaatcggatcggtgttttcgctgtaaattcatcgccaactgtaaagttgccttcaccctggcggtcgtaaacgaaagtacgaatgagcttatccaaattgggggtggaataggcagaggtatagtcaatactgaatacatctttttcgttcgtaaattctttctgtagcacaacgcctttcgctttgccacccgaggactgtgttcgtccgtctactacaggaaccggatgaccgaatgatccttttatcttatatttctgaggagcgtctccgttaaagtaatcaccgggataggagttcggaccaccctgatcgccaaccatcgtttcacttcccaaagctacggcataagaaccgacatcattgtggttatgattctccgcattggttccgcccttggctgatatggccagacgacaggaagttccaccggcaggacgagcaatcaaaatacctgcctgctcataataagcgcgcaaagcatccgactcttcctgcaatacctgacggattccgtctgtcattccaacctttgcaacctgacttgtgaaaagttcgagaaggtgaagggacaagttgtttcctttgggtaaaacaggctgttcttctgcagaagtaatacccagcgcccggtcgcagtaactgagaataaacttgtccggcgacaacccgatgcgacaatccgaataggcggggcacactccttcattcatctgtatcttcttcccataccgggcgatacggacaaacttgggagtctgaaagaagtcgatctttccctgcgttgcccggtatacttcttcacgcaacagaatgtaggcacagaaaccataattataataacctacaccttcactacagtagccgtcgtcagcgtaccccttcattccatacacgttatacttttcggctgccgcaacaaagtaagcacgttcctccttatcgggcaacaaggcaagagccgcaccggtaacacccgccagacacacagagttccagttattggtagcggtgaaccaccaaaatggttttgtctcttccagacaacggtagaccggacggaaaaccttctcacggaaagcacactgcacccgtgcccttacctccggcgacagacgatcgtccagcatggtaacacactgagcaataccgtttccggcagtagcaaccaccaagtctacataataatccgttcctttataattcttcagaccgcggtcgtgggcaggaatagaccaaggcttctgactgcaaagagccaccagagctttttcgatggcagggacataacgcctcttattttcaaggcattcagccaaagtcagcctgtacagatattgataacgggcattcatcatattctctccaggcaaacgaacgttcgtcttattcaaatgcaggtacagtgaatcgacaaaagggggcatcccctgctttaacaaagcaggagcttccttttccagaagttgtttagcgtcgtcactctcttttatcttattccagaaagtcctgtccttataagacgttcctatcccctgcggtcgatcgggaagcatagctgcaatttcctgaatacggttctgcgggatagtagcattctgtttcggagcgtcttctgccatacgatacatttccgttccggcaagcaggaaagcacccggtccgtatacttctgtcatattgcgggtcactttctttgggtcggcaccgataggttgtacatatcctagtttaccgtcttcttctaccgcagaaagcagtgctttccatcctttctctactacaggcaggaacttttcctttggtaaaagtccctcgttcagtccataggcaagggcatatacgaagaaaccgctacagcttgtttctggtgatggataagcgtccggatcgagcagacttgcacgccagaacccgtcgctgctctgtaaattagcgatgcggtaacagagtttctgaaacagttcctgatagaacggacgatatttgctcttggcaggcagttcacgtagcatttctaccagtccgccaagcacccagccattgccccgtccccaaaagactttggcaccattactctctttcatatcaaaataacggtggtcacggtagaagagattttcttctttatcgaacaggaactcgtaagtcgctttgtactctttatccataaagcgaatgaatttcttatcaccagtgatattatagagtttcagataaacggggggtgccatgaaaagagcatcacaccaagtccagtgttctaatgtcgtggcatctccgtaagtcaactgaaacgaacccgaaggaggattggcgaccacccactccgtacgcgccagagtaggaacaatcatgtccttttgcttgtacttttcgtacagatacagataggtttgagcaatacaaatatcatctgcatgatacatccgtttatctacctgccaatagttacgacttcccaggcgggtcagccatttataatagaagtcatcctgatcgtccttctcagcgatctctgcccaataagcaagtcccaggaaaaaggtggcattcacccagttgagatcaccataaacagctctgttgtaatgaccgatctgccaatcggctaccctacgcatcgattgcttcacttcgagtttagtaaacgattgtgcatgtgtcgtgcataaataagctatgcttagaaaaagaatcaaaagtaatttcttcataatatattttttaatttatatgctttggatgcaccggcatagataccggtatttctaaaatcacataaaacagtctttcgctcgctggatatttcaggaatcagcaattcaactttaatacaagattgtgtctgcccaggatcagcaatatgcagttcggcattaccactgtgtccatccttaatcatcaatgcacaggctttatccacacttacagaaagctctccgttacggaatgtaccctctttataaaataccatttgccatattcccaatttcgtatgcctcactatctgcatagaatccgtattcgccagaatttcgacgggactcttcctgtagttattcatcttgcgggcagaatgaatcccaggcaccacgatataggcataggtagcattccggggattacaaccatgattaaatcccaaagtaaagacctcttgctgctgctcatttttagattcagtatgattaatgctgtaccacgatcccgtctgtatcttcttgctcaaaaagagatttccgccggcgggaaagacataaccaattccattgtgcaatacccattcgggagaatcatagacgaaatctccttctttcaccatcgactgcttcttactttgtgacaatatgacctcctttttcgaaagcaaacattgattgatagtagtacataccggtacaccggctgtcgaattaacccccgctcccaaacaaatgatttcatcatcgaaaaagaaccaggactttttagctgcggtatttatatcagcataggtatcaagatatgaataaacagatacgccataaagactatcagagactcctcctgcaaatacggaagttcccttcgtttgccaatcaattacagttcgtggaatggtatccagttgaggagcagtcactccaggaatacgattccagttccataccggaaagatgcgggcgtactcgtccccttcggtcacgatgtttgtacatccgtcggacataaaataggttttcagattttcaccattcccatattcgcatcgcatggtacgattggaaaccatacgaacgtcaaatgtatagtggggacggacatgaagagcatagtctcctctgaaataatgagtgtgtaacggctttattccatagttggcggacttcttgccttccaatctggctataatcgcattgtattcatcaatatgtgccggggcgagctccagcattcgtttggcaaacaaggcggcatgactcttttgggtagcattattacggctcactcctcttcccaatacatcgaaaagcatgtattgtccacgtataacctgataataagtgccgcacataaaatgcctcagaaattgtattctctcatcatccaatgcatatttcgttcctttagtatatagagctacctgtgttactcctttcagtatttcgtctccataaccaccgatataaagctgcacgccatgctgaaaatagctgttgtcatgctgaaatccttctttcacagtatatgatagaggactataaacattctcaacagccgttttcaagtcaacatcattcttctgaaggcaagctctataaatccaatgtaaagcaatatccgtccggttggctccagtccatctggcaggatgtccgccgtccttccgcatacgttgcaagacctttgtctccaatacttccggaatctgccttttaccaacacgcatctgaataagcagaataccgagtttctgcggctcggcaatctgattataccaccagttattacaatgtggattacgatgatgccaatactccaagccctttactatcttatgatacaaatcttcattctgataataggaattctttggatgagtataagcaaatacaaagtcatacaaccgatccacatgaataagtggcatccagttagtacgatcccggcgggcataatctatatctataaaacatccttggacgtcatcatacagttccagagctttatcaatattcggattttctgcaaccccatcccgaatcttcttcattagaatatcaaaatcatcattctgcaaggcagacgtacaaatagagggacaaggtaaaaccaaatcccaaggactccatgccagcaataatagaattatgattttataatgtatcattttcatatatgcatgtttatcatttggagaataagggggtatgtcaaaagtaactaaattcccttcttgaaggaggagagcttagttacttttgacacaccttctcatccttaaaatacaatcaggccgaccactcaggctacttcgtatatttaacaggtttcgaccagattttatccaatacgttttcctgcggagcatacaaggtttccattataaaagaatcgcctgtaaaatcttctaaaacgtcctgtccttccttattataataagaaatttttgttgtttcttctcctcccttgttccaagttagcctggatgccactaatgtgctgtccagcaacatggaatatttgatgaccagattaccactctgcatactcttagaaacaatggaacgatttaacagatagctctggtactgtgtcccataaatggttcctgtaaagtctgtagccaatgatttattcaactcatcatcttccagccaggcggaaaaaatgatagacccctcccgcatattctctaaaagaatatccgtcctcttatttttggccaactcatatctgacagtatcactttgattcaatgcaagagcaatctttgtagatctcccgtctttcactatcggaaatgaaatcaacactctttcccacccattacgcacggttattgaatctttcgataatcgtgtaagatacatgattggaccatccttaacaaagtccttataagtcgcatccattgactcgcaagatataatggaacaaaatatcaagatgctgactgatataaatataaatttcttcataatatttgtcttttatatagcgattactgtattattttatcctccggtgttccaaagaaagtaagttctgccacattgatacgagatgttcctacattataattcttgatacaaacaaacgtcacatatctatatgcatccagatctacggaaaattcgagttcattgccgtctcttgccagttccttatcagcatcagttaacgggacaatagccgccggaataacagaaccgtcggctctgggcaatactccttgatataaccgtacccatccttcatcattttccggatcaaacttggttacattattatcatttcgtccccaaatttctatttctttcggatacagaccgtcaaatatagatgaataatcagttccatttcttcttccatagacaatcatacggctgagcttaaacttcttccctaagtccagtgtcaccgaactcggcttggtaaaatcatatcccgccgttgtgagggtcataaaagtattattgcttccaataattccgtcatacagattctttggggtattagcattcggtgccagataacctttgtattcgccaatggccaagtatcccatttttttcttatctacttcctcttcataatatggagtcagagatatctccttactttcagaaagatgtccccacctatccttcaccaccacactaaattctgaaggaacggcttccataccacgtatgggctcattaatctcttgctttttggtatataaagctccggcttccgtccattttccagtagcatccttccggtacacataaaaagtaagagtctcattgctggtgttggatgtctttatccggataccggcaaaatccggttttatttccatctccttataagcagtgatataaggcggctcttccggatttatttttacttccagaggttcagaataggcttcacccggacttacagaatacaacttcacattatattcaccagctttttcaaatccttccaccactacagagtcggcaaaatacgaagcattggtcgaacgttctcctatctctgtcatatatacagccttcatataaagaaaattcttatcactgggctgtgtaaaatagattatagactttcccggcagatttttgacaccattcaatactacctgttcaggcggagtcgtacttccatggggagaattcatatcactatcgttatcgcaagcactaggcagcaatgtgatggctagtactaaaaggctactgtatattatctttttcataaatcaaatgtcactttaattacttaccaaccataattttgaactaagttaggatcttttctcaactcaccgatatcaataggccagaaatacattttgggagtgaaatcccggacaagcactaagttctcactataataatctacatcagtttctccataacggactttccaaccggtcaatggctgtgtcaattctgttgtcgcagttttccaccgacggacatcccaaaaataatgtccttcaaatgctaactcaatacgacgctcctgcatgatgatttgtcgtagaccagtctgagtagcatacttgctgtttcctacatattggtcccaactttcttttacgccttgaagtcccgaacgttctctcaccatatcgatccatggcaataccgtagcataatcctctcctttttcatttaaagcttcggcatacatcaaatacaaatcagccatacggataacagggaacggataagtgaccgatgtaaatccggaagccgcatcggacatgaccgtcttgtagttaaccactttcttaggccaaataccagtcaggttctgagagtgatctgccggaatgggagacacatttcctcctttacgcgcattcaccgaatacaagcccgaaagtcccgtctttccttgtccgaaccaaataccgccgtcaaagcctaagctggcataatatctgtgttcacgttccagattcaatttgactgttcccgttttataattcagcataatagtattctcatatccgggctcagcttccaccggcgtgggagcctgcacttcaaatctattagcataatcccatgtcttatcttcttctataggaaccccatgtttagtataaaatgagttagtcagtccaagagaaacacccagattggttctgttcgtagcattcttagcatttctgccgggaaccaagtcacgcggcattgcctgtatctgatagttgtcataagaacccgaaccgacccatgactgagagtttgcccataccacttctttgttccacttctcagtgacagcacctcgcaaattcatcatcagcttgtcggactctgtcatgaccacagtgggatcatcaaaataatataaaccgaatcccaaatcttcgagataagtaatggcttctttacacgcttcggcagcctttacccatttctgcttcttctcctcttccgttttaaccggattaaagattttcacacctctattatctgcaattacctcataatccatatttccattgaacaatggacttgcagcggttaccagaactttcgctttcaatgctttagccatacctacggtcactcgtcccagttcttcagcttcattctctattttagccggaacatccggattagcaatcaccttgtccaaagtttctgtcacataattgaaacaactgtccaatgtctcccgataaggatgcatttcctccgtactactacttaccggaacatatcgatccataataggaatcggtccatacatcctgatcagatagaaatgataataagctttcaaaaattccacttcaccgatccatctgtttttctcgctatcatccatatccggtgtagtatgtatattctcaatcagaatattacaataagcaattccctcatataaatgtccccattgagcacaatatggtgaatcggacttttgcaatccttgggctatataccaggcgctggttcccaaatagctccggaaaacatcggaaatacaaaaatcaccggcaccaagcaaagctacattatttttgagacttccgtcactaggcatatacctgtagcaagtaaacaagactttttccgcttcttttctcaaggcgaaagcatggtcttcaatggtcggtatgttatccgggacgatattcagttcacatgatgtcaatataaacaccgacaaacatgacaatatacatattttgatttttttcataaccattctttttagaaacttacatttacaccaatattgaatacacgttgtaacggataattaagaccattacctgccaattccacatcccaatccttgaacttactcaaaacaaaaagattggtagaagacatatagagcctcagattggacataccccatttgctcacaattttttgaggtactgtatatcccagttcaaccaatttcagtcgtaagaaggaaccgtctctcatgaaccatgtactcagttctttattgttggcaacagaagtggttgacaatctgggccatgttgcataacgattgcggttactttccgaccaatagctatttgcaataaatttcactagttgattattagttttctgagacatcttcgaatctttaaagaatggagacatcttatcataatcaatccagaaagaagactgcgccgagccgtggaactggaaattgatgtcaaaacctttatagctaaatgttgatccaaagccatagttgatttccggactagtcggatgtccaataggaacttgatccaatgaattaattactccatctccattcatatcccggtatttgatatctccggctttataatcaccaaactgtacaggagagttggccacttccgcatcgtctataaatagcccttccgcaatgtatccccacttctggttgggcgagtagcctattttgtatttccaccattccttatcatacgtgttatcttcatatttcagatattcactatgcgcataggttaagtttccgcgtactatcaaaaaagcgtttttgttaaggttcttttgatactttaaatcaagatccacaccgtgtcctttggtctcgccaatgttagcatatacgtctgcctgatatcccattacgcttggaatactggctcttttctgtaatatgtcagtacgatgttctgtgaaatattcagctatcaggtcaaatccgtagaaagaagcttccaatgcgaaattagctttacgggatttttcccatccaatggcaggattagcataacgtgaaacatttacgcccggtctgctatatttgttttcatacccgaaagatgctccacctgcattcatattcacattagacagatataagaaacgttcatcgactctgccaatcttatcatttcccaccaaaccgtatgaggctcttagtttcaatttcgtaatttttgaactgagcggttggaagaatggttcgttcgaaatcatccagccaccaccgacggacggaaagaatccccatctgtgtttcttatcaaagcgttcggaagcattgtatccaaaattgaactccgtgaaatagcggtcactataggcataagtaaaacgtcccgacacacccatatttcttgaaggcaagctctcctgcaaagttttgtagtttggattcttactgtcgatatactgagtaacgataagaccacctacggaatgatcaccgaaagtctgattataactggttctcgtttcgattgtcattacattgttgacagtcttgtcaccgggactaaaatcaaggtattccgttccggagtcaggattgatgttttcgatagaatatttctctgtcatgaaatcataagaacttaaagcatagtaatatggcttatattgtctggtctgaccgtaatatgatttacgagaaacgttgaagaaaccttcaaatttcaaacctttagtgataaagttcaagtcctgcgtaacacctaatgtagcaagaagagtcgtattctcatattccttatatccttttaccatttcagcatacgggttaagataacttccgtcatcgctgtttccaaaaagaatgtgtttgatatatttatgttgttcatcggtaggatatacagcgggaaaaagtacaggattagacttcattaccatcttataaatatccgatcccgaataaataggaccttcataagtgtcaaagattccacttaagtttactcttacctgggtcgtttttgtcacattgatgttgacattagccctcatctgataagtctgaagattgatattgttgttgaagttgttcttgccgtctacgttgagcaaaccctggtctttggtatatcgcagagacacgtaatacgtagccgaatttcctccgccactgatgctcatgttggctcttccattccaggtcgagttcttcattagttgccttctccagtcatttgtaggataaatgatagaaccagatcccggaacggttctgtctattttatcatcactatacatgacaggggcggaaggatcacgtgttaagatggcttcattatgcaatttcatgtaagtgacagggtctgccaactcaatattactggtcggacgagaattacttccctctattcttacatcaaacttagtttttcctctctctccctcttttgtctttactagaacgactccattagctcctctcgaaccgtaaagggccgttgccatggcatctttcatgattgaaaaactttcgatatcatcgggattcaaacgccctaagtccgtacttgtagattcaatgttatcaatcagaatcaaaggactggtgttaaatccaaaagatgcgataccacgtacaaaaaagctagcatcgtccgcacccggctctcctgatgtctgataagaaataataccggctacctgacctgccaatgcagttgtcatattactgctcggcactctcaggctctttggcgaaagtgtagtgatagaaccaatcacactctccttcttttgtgttccgaatgccacaatttccaccgcatccagttcatttacgttttgtgagagttggatggtaacgtttgttttctctttcagtggaaattcttgtgtgttatatccaataaagctgactaccagcacatccttttgaggagaagccatcaaaataaacttaccatccagatctgtgacagttccactggtgggattacttttaagagtaacattcgctccaggtattccttcaccgctctcatcaaagacctgcccggtaatcttaacttttgcatcactttgctgctgactcttttcatcaccagtcattttctgttgcccatcttgcgaatatgctcctatcgcgacaaagcaagctagcagaaacaaataaaacttttcaattttcataaattattagattagttaatgataaatacttgttttccatttaaaagagattctttctcatttcattcataggcttttatattttagattcaacatttttcagattacatacagaaacgtctccgattaccaacctgcgtgctcttctttgttttcactccaatcggcacttcgcttcttttcgccggtatagttccattcaatctcgtcagtgtattcttttccattatatgttgcaacggttttaattgtattcttaccttgttccaaggttacatcagccaagacatagtgcacatccgtgtagccttggcgtatacccgtcagttcttttccattaagatacacttgcggtgtacctatgttagaataaacagtgacagaagtatgttttcgttcgcggtcgatgttgcgacgctgggtcaggtagagtacgggatctttgctccagttagctttataccagtaataggagtcctttttgattttccggtcaaaagtgatcaaccccttcaagttacgggcaggtacaccgccacggctccacatcggtacaccaaagtcaaacatattccaaagataagaagcgatgatatagggatgctttgcaatgacactccattggtattcatgcgtcttggtctgaaaagtttccggatagaaagactttccccagttcagagcatcacccagatattctgtctgatggtccagatttgcatcagcaccatattccgtcaacatcagtttctgccacgggtatttctcctccagcccttttacccaaggctcgatatcctgcaactttttctcataccatccgaagtagcggttcattccctgaatatccgcattttgattgaccggatgctctgcatggccataaccatttacagatacagtgtagcggtcaggatcctctgtcttggccagattatgcagagtctgtgtcagtcctgccgtatattcgtggggctggtatacttcattgtgcaatccccatacataaatggaagggtgattgaaactttgacgaatcagttcacgaagctgagactgtgcattttcggcttcatatcctgtcacccgattcacaaaaggaatctctgcccagatgaccaatcccaaagaatcgcaacgggaatacaggtaatccgactgttgatagtgggcgaaacggacagtagtcgctccgatatccataatctgagccaagtcgaaatcatgttctttgttggtaagcgcactacccaatccccaccaatcctgatgacgggttaccccatacatcgggtatttctcaccattcaagtagaaacctttgcctggcacaatctcatatctacgaacacccaatggctgtaccacctcatcaattacttttccgtccgccagtaagcgggaaataaccttatataaataagggtccttacgtccctgccacagatgcggtttattcagtttgaaggtagaaatgtaagtctgtgttccctgcggagtgagtaccaaaggaaggcgatgggaagtgaccttcttgccattctgcgtataaatggtattttcgagtaccaagtcagcaggagtaagacttccattgtccagcttcactttcactgtgatatcggcagagcgtttcgatacattcctttgagtaatatatacacccggagaggcacaatcggtaactgtaatgttattctgttcagtaataatcagccataccggacgatagatacctccgtaaaccccaaaaagattgtgatttaccggaatcacatcagaacgtgaagcattatccgcctttaccattatctcattctcagctcccagtttcaatgcggttccaatttcaaaagcaaaggcgctgtatgctccccggtgcattccgacaagtttaccgttgacatacacttctgtgttggcgcccacaccttcaaagcgaagaaatacacgcttccctttcaactcattgccaaagaattgtgttttcctgtaataaccaactccttcatagaaagcatcagcttttacctgcatatctttagcgttccaggtatgaggcaagtttacagtttcccagtccgcattccattgagcagcgaccttcaccgggtcctgtgaaaaaggcccgcgtttgaatagccatccttcattgaaagaggtcacttcccgggcagagagtgaaagaatctgcccgataagcgctgataaaatgagtatatatttaaacttcatagaatcgtttctttatcatttatgttaaagcatctcgataaatactttttgttcctttagctgcacgaactttaagctgaattacataaggttcacccggattctttttaggaacagatacgttatattcattgcgggttgtctcaacaacagtgatatcttcaccggtagtcagcaaagtggctttttctactgtaatgcctttcggagtctttacaatcaaccgttcactataaggctgattgaatactaccatataaacttcatcgtttttaccacgtgtataatatccccagtcttgtttttcaaatccggcataatcgcaagcataaacagcttttccgtaacgattcatccacttaccaatcgctgtagccattgctttctcttcgggacggaaatcaccatctgcctgaggcccgaagttgacaaccatgtttccacccatggaaacagcgtgtacaatgcggtcaatgacttcaatcggagttttcacatagctcaatgaccagtctttgtgatatccccattgattttcgggtatagtcatgcaggcttcccagtcccactgtgtaactttgagatctttcaccggatcgggcaagcggcgttcgtagccggattcgtagtcacccatcagacgaccattgctatcaaaatgtcgctttcctttgtcatcagcacgtaagcggctattgatggcaacacccggaacgagttccttcaacatttgttctgcatgagctgtccaccaaccattctttttaacgctggcatcccacgtaccatcaaaccagaagtccttaacggtcgggtaacgtgttgccagttctttcagttgattgtcggtaaattcaaggaaacggctgaaggcgatgctatcttctttggattttatatcataacgataatccggattactccagtccatcactgagaaatagaagtgtacatcaattccttcgtcattataggctttcaccaactcgcccaatatatcacgcttatatggggtatttgctacggtatatttagtatacttactaggccacagacagaagccttcatgatgtttcgttgtaatcttgacatacttagtacccatttctttggccatctttgcccatttcttcgcatcaaatttcgtagggttccattgatccatcagtttcagccattcatcagcaggtacttttgcccagcttttcagccattcggcagctccgccatatacttttccattccactctcccccggggatagcatacagtccccagtggatgaaggcacccaaacgattgtcacggaacttctgcatggcagggtcttgccgtttaccttcattcgtagctccatatttcaaaggaatttccttctttgcttcttgagcaaacgttacagaactgacagtaatcaataataagagtaatgttattaatctgcttttcatgcgataaattattgtgtttttcatacttattttattgtctttgattctatgtattaaaacagaatgaaagcattgcaaaaataggagacctatatgacatccataaacacaaattttgcaaaaagaacatttctgcatccacatggaagatttggtcacctataatggaagatttggatacatcgcccttctttttctgcacaaatgatgttatccaacgtatagcaacctataggcagacattggggggattaatacctggtttgtcaggtattaacagctgatatatcaggtattaacaactgaattgtcggatattaatagctgatatgccggatattaatacttgagaagtcaggtaatgaaacaactactccttcctactcctgactccttgcggagcaatcccgaagaaggctttaaaggatttgctgaaataacggggagaagaaaagccgagccgaacggaaatctctgttatatttagttccggatgctctgtcagcaaagacatagcttcatccagcttcactttcaagatgaactcattcggagtcaacccggtcatttgtttaaactgcatatataatttgctacgtcccatacataattctgaagcaagcgcagtaacatcaaaatcagggttctcaaaattctctctgacaatatttacacatttcgtcagcagttctttatctttctcattaatagcttccgctacaggagattccgtaatgaccttacccgcataatgtgcaatcagacgtttcttgttttttatcaagttattgcaacgggccaccaatacctttatattaaacggcttcgttatataatcatccgctccgaacatcaaaccttctacaacatattccacagaagtctgtgctgtcaacagaacgacagaaatatgagaaagttctacattggtcttgattttatagcacaagtccttacctgacatctcaggcataatcacatcacttactatcagatccggttgtatttgttgcgccatctccagtccttcgcgtccattacacgcagtatatacattatacatcggtaagaatatatcttccagcatggacaatagttcggtattatcatctaccaaaagaatcgtaggcttatcttcttcatccatatttttctgcgattcaggttcttttatctcttccgccatcaactgtccataagaagatacagaagcttccggaataatcagtgactcccgaccttccgtcacagccatctcttcatcactgaaatgtcggtttcctaaaggtagagacaagataaacttagtaccctcaccaacagtactttctacctcaatctttccatgatgcatattcataattccttttgccaacgccaatccgatgcctgtccccaaagtaaaagaagaggaagaagaggcattatccgtctgatagaaccggtcgaatatcttcgaaatatgttcaaccggaatcccaatacccgtatcacacactgaaactacggcctgtgaagcaactttccttacttctacagttatatttcccttattggatgtatacttaaaagcattcgacaataaattaaaaatcactttctgtaactgtattggatcaaaccagacagaaatcgtttcctctacagaatcaaagcgatatgtgatctcctttttttgtgcatattcataaaaacacatataaatctgacgagtaaaagtaaccaaattctgttcttcaactctgagtttcaaataaccctgctcctgtttgcgaaaatcgagcaactcggagatcaaattccgcatatgccaggcgtttttatatatacgctgaatacgattataaacggttgtgcccaaatccatttgcatcaatacttcaatttgccccagaataagcgttaatggagtacgaaattcatgagaaatattagtaaagaagcgcaattttacttgattgagttcttcaatcctctctttttcttttcgctcaaactccaatgaagacctcagagccgcctgccgtgttttaaaacgaacaaatgcgaccatcaatgcagtcagacaaaggacataaaacagatatgcccatatggtagcataaaaaggagcggaaacatgtatattcaagcagattgcatctttcaaactctccttattttccatcgaacgaactttgagcgtatagtctccaggaggcagattggtgtaagtaaccgtagtgcccgaagtctgggtccacaccttatcgaagccatccagataatattcaaacaaacgattacggtcactattataattaaaagtagcaaattccactgttacgttattctgttgatagcttaaaaagatatccgacgttttcgccaatatctcagtcaggatgccggactcatcaccaggagctatttcgtcattgaaaataaacaatttatcaaaattcaagaagcttttgacctgagattcataaaaggaccgctcttgaaacatagccaatccattggtaccactgatataaataatcccatttttgcttcgatataaagcggaccccaaattataagtctgacgaaacaagtgataagtctcttctgtaacctctttttcacgatcaaagatagaaagccctttcccatgcaaaacaagcagacaattatcccgggcagactcgcagatataataacaataattactcggaagtactccattggtagttccgtaagacttgaaagtatcctgtttctcctgatacttgaatatccccgcgccaatcgtactaaaataaatatctcctttattatcttcaaaaatatgcacggttttgtatcttcctaccgtcaacgtgtctttctcactatccgccatatattgagtcacttttgaagaagataaattgacgcacactatccctccgccaccaacagcaagccacatacgatgccggctatcgatcagaaacgtttcaaaagcatattcccgactgatcaatttctggacagacggatcatccgtaagcggtgagaatttctcggtcaccggatcaaaaaacaccggaccaccttgtgtcaacatcgcaatgccatccttatactcctgaatatcgttcacaatctcatgaggcaacgaagcagggtcaccggtaacatgatggagagtgtgtcccttgttcgattttaaatccagaacgaacaatcctcctaaatgagtccccgcatacaatcgattattctcctttctataaaagatcgacttgacattattactccctaatgtcccctgatctcctttatgatacatatatcgggagaaaacgccagtatccccatgataacaattcagccctccaccttcagtacagatccacacatttcctgcactatcttcagtcattttaccgactaccggaaagctgagacagtcttcacgtaaaggttcggcacaataaaagctatgattattcttatcgggattgaatacattcactcctccataataagtcccgacccaaatattaccttgcatatctttatgaagagagagaatagaagtatggcttaaagaatttgaagaacttccataacgcgtataatgactccacgtatcagtaaccggatcgtaacaatcgattcccttgaacgtacctacccaaatatgcttaaaatcatcttccagcacgcatcggacctgattatcggataattcacccattcccgaatgactaacataagcggttgtctcccgattgggagaaatacggtacaagccgttccaagctcccacccatatatttccggaactatcgcctaaaatacaattgcccttatcaagggtaagtaaaatctcttgccgaagagggtcttcacgtgatattgcgaccaagtattttctggtaaccacccatacagtctctttgtctacatagagtgctctccccacaaaacctttctgcacacgagcaaagaatgtcagctctgtaccctgtcccgtataataataaatgccgtctgcacaactcacccaaagtgtatctttcttacaaaacagtccatacacacctttctgtcgcaaacaagtgaattgctccgtataaatatccagtttaatcagatcgtttcccgaacgaatatacattcttccgtttttatctccacataattcgttaatctcattattagtcagtccatgattactttccgaaggctggaatacttttacatccttaccgttgtatctattcagtccctcagtagttcccagccagactgcccctaactcatcctgataaattgatgggatacacacctgagataatccatcagatactcccaaatgcttaaaataatgattagtggcttccgccatcaccatagataaaagacttaagagaaaggttattgttcttcgccacattttacacataattatattgcgggtagcaaaaatacaaaaaaaacataattattggttaagaatctctttaatttatacccttccagccgaaatgcagtttattcatttgacgattcttgctaaaatacagtcccacagtattttttcaaggaaaaatcaatggtgtttttaggttaaaaccatatctttgccacaaactaaaaagaataattggatgttaatcacatttacattccgcaaggatctcgttctgtaaataatctgtaagtcttcctctcattacagattatcccttacattttctccggcatattcatgtcagagttgatttctattttctaaaaaataacaactattgtaggctcaaatggttttatgcatcctcgtatgcctccatttgacgtacacctaaaacattaaaaacaatgagtaacaataatacatctatacatgatttcgatttttctttcatatgtaactacttcaagctgctgaaacgtcaaggtcccggaagtccggaagccacacgcaaagctgtaagtttcatcaacgaactgaccgatgatgctaagattgccgatatcggctgcggcacaggcggtcagacactgtttctggctgactacgtgaaaggacagattacgggcatagacctctttcccgattttatcgaaatattcaatgagaatgcggtgaaagccaattgcgccgacagagtaaaaggaatcaccggatcaatggacaatctcccgtttcagaacgaggaactcgacctgatctggtcggaaggagcaatctacaatataggattcgaacgtgggatgaacgaatggagcaaatacctgaaaaaaggcggttttatcgcagtgagcgaagcatcctggttcacttcggaacgccctgcggaaatagaagacttctggatggacgcctatccggaaatcagcgtgatcccgacatgtattgacaagatggaaagggccggatatactccaacagcccatttcatcctaccggagaactgctggacagaacattattttgccccacaagatgaagtacgggagacattcatgaaagaacacgtgggaaataaaactgcgatggatttcatgaaaggtcagcagtacgaacgaagcctgtatagtaaatataaagattactatggctacgtattctatataggacaaaaaagataatcattatctgtgccggagaagttggcaagataggacaactctccggctcttattattctttattttgcattaaaatggaaacgaaagaaataaataggcaggaatataaattacggatcgacaaagtgaccgaatatattcatcaaaacatagaccaacctctatcattgcataagatggcaggaatcgcgtgcttttctcctttccactttcatcgcgttttcacgtttctgacgggcgaaacaccgacggaatatatcaaacgcacccggattgaaaaagcagcactgctactacagaatgacaggcaactgtctgcgaccgaaattgccagtcgctgtggtttcagcagtttatcactcctcagccgcaactttaagcaacatttcaatatcactatccgtgaatttcgttcacaggaataaacacctaaaaagacatggaaaatcagattctaatttttcggacctccatcacgaagagacgcgacatcaagctcatcggaagtctcctggcaaagttcccgcaaatcacccgatggaatgtagatttcgaggactgggagaaggtattaagaatcgagtgcagcaatatcaccgcactcgagatttcggaaacactccggaatagtcatatctttgctacggagctggaataagcagttgtttcagttcctccaccccttcagaagctcctttccgaaggacgtgtatcgaacgggaagtatgtgtatccaccggcttcgggtctatcagatacacctctgctcctctcggtacataatgcagcaaacctgccgcaggatatacattgagcgatgtgccgatgataacgaatatatccgccttttctacatatcggacagctgtctcaatctccggcaccgcctctccgaaccagacaataaaaggacgcaactgagttccgtcaccggccttatctcccatttttacttcatactcttccggcttcagttcctttatataatgagggttatacgggtctctgctggagcagacctttgtcaactcaccatgcaggtgaatgatatggctgcttcctgcccgttcgtgcagattatccacattctgtgtgataaccgccacattgaaattcttttccagttccgccagcagttcatgtccgcgattcggcttcacttccagcaattgtttccttcgtgcattataaaagttaatcaccaatgccggatcacgctggtatccttcgggagtagctacctgctccacaggatatttatcccacaaaccgcccgcatcgcgaaatgtactgattccactctcggcactcatgcccgcacctgtcaatactaccagattcttcataaccgctcctccttattattaaaagatatacaaatgtaatcagaatcattgaataaaagaaaacttccgcccgcataatctaatccaaggtatacaagaatttaataccgtccatacgaagacttcgtgccggatatactaaaatctattcgtctgactatagtaattctttcgtctgactatagtcagacgataattcaactgtagtcagacgcaagtttaactatagtcagacgaataaattccagcataaacgaacttaaacagtaagaacataaagattaaatcttaggaatgaaggaattaattccttaaagaaaagagactaactttcacggatataagaatttttaaatactaaatgctaaatcattcaaataaaacgtgtacttttgcgattcataaatttgcaattgattgaaagctaaaaccatgaaggtgatatgcttcgatcttcaacaaaaacattatatggataaattcagttacgctattggcctcggaatcggtcaaaacttattaagcatgggtgcaaaaggcatcgctgtagatgactttgcacaagcaattaaagatgtattggaaggtaatcagacggctatcagccatcaggaagcccgcgaaatagtgaacaagtatttcgaagaactggaagctaagatgggcgctgccgccatcgaacaaggaaaagctttcctcgaagaaaataagaaaaagccgggcgtggttacgctgcccagcggactgcaatacgaagtgatcaacgaaggcacaggcaaaaaagcgaaagctaccgatcaggtaaaatgccactacgaaggcacactgatcgacggtacactgttcgacagctctatcaagcgcggagaaccggctgtattcggcgtcaatcaggtaatcccgggatgggtggaagcattgcaactgatgcccgaaggttccaaatggaaactctatattccgtccgaccttgcttatggcgccagaggtgccggagaaatgattcctccccacagcacattggtatttgaagtagaattactcgaagtattataaataaaaaatttcaaagcaaaatgaaaaaagttagtatttttatggcaatcgccgctgctgcaagtcttgcttcttgtacagctcaagctcctaaagcaaatctgaaaacagacatcgactcactgtcttactctatcggtatggctcagactcaaggtctgaaaggctatctgacaggccgtctggacgttgatactgcatatatggcagaattcatcaaaggtttgaacgaaggtgcaaacaagaccagcaagaaagacatcgcttacatggcaggtcttcagatcggtcagcagatcagcaaccagatgatgaaaggtatcaaccaggaactgttcgctggtgactctaccaaaacgatcagcaaagacaacttcatggctggtttcatcgcaggtacactggaaaaaggtggcgtgatgactatggaagctgctcaggaatatactcgcacagctatggaaactatcaaagcgaaagctatggaagaaaaatacgctgacaacaaagctgccggtgaaaaattccttgctgaaaacaaagctaaagaaggtgtgaaaactactgaaagcggattgcagtacaaagtaatcactgaaggtaaaggtgaaatccctgctgacacttgcaaagtgaaagtgaactataaaggtactttgatcgacggtacagaattcgacagctcttacaaacgtaacgagcctgctactttccgtgccaaccaagtaatcaaaggctggacagaagctctgactatgatgcctgtaggttctaaatgggaactttacatcccgcaagaactcgcttacggttcaagagaatcaggacagatcaaaccgttctctactctgattttcgaagttgaactggtaggtatcgaaaaagataagaaataagaaagtatctttctaaatagaaaaaggaaaggggtgcaaagtctttgcactccttttttttgctttttcctattttttttcccgtaaaagaagaataattaaaataaatctctatatttgcttactatttgataacaacaggaaattataatttattattatggaaaaaatagacaacctcgacaggcagattctagagattatttcacagaatgcccgcatccctttcaaagacgtagcagccgaatgcggagtgtcacgtgcagctatccatcaacgcgtacaaagactgatcgacttgggcgtcatcgtaggctcaggctatcatgtaaacccgaaatcactgggttacagaacttgtacatacgtgggaatcaaactggaaaaaggttctatgtacaaatcagtggtggccgagttacaaaagattccggaaattgtggaatgccatttcactaccggtccttacaccatgctgaccaaactctacgcatgcgacaacgaacacctgatggacttgctgaataacaaaatgcaagaaataccgggtgtggttgctacagaaacactgatttctctggaacagagtatcaaaaaagaaattcctatccgcgtagaaaaataacagaatggaattcctgaatgaatatcaccttgccgggttatttatcggaatttgtacctttttgattatcggcctttttcaccctgtcgtggtaaaggccgaatattattggggcaccaaatgctggtggatattcctgatactaggcattgcaggtgtcgcagcatcgctgagcatcgacaatgtcattctgtcttctctgttaggcgtatttgccttctcttcgttctggaccatcaaagaggtctttgagcaggaagatcgggtgaaaaaaggctggttccccaagaacccgaaacgcaaatataagttctgagaagagaaagtattgtagttttttattgttaggacttgcatatttcaatagaaaatactacttttgtcaccgcatccagtaaacggatacaccggacttgtagctcagttggttagagcaacagactcataatctggaggtccctggttcaagcccaggctggtccacaaaaaaggttgtaacacaagttgttacaaccttttttttatatccggtatcggaaccgaatctattgcttcctctaatttttgccccctttcagagaatttattccatgcccaaagtatatgagaatatactagttcccacaaaattatgattttaaagatacggaagaggtaaataaaacgggcatcattaaagaaaccctagatagggactaactaaaaaggcaatagtatctccaattcccctcccttcgggaagggatggctgaaagccggggtggtaggtaaaacaaggttgtatctattttactatgaatgaaagaattgcgtattcacctaccacctccccctgcgggtactcctccttcccgaaggaggagatttaagatactaccgactttttaatcagcccaaaaaaatcccattttgaaaaccactcttggcaccaaaatgggataacacaaacaaaacaaacaatattggagcgattttcacaaacagcttccttttcttaatctatatttcataacacttattagttctctctaatgtgaaagtaatatttcaccgcaaaaatattatttctccattacatataaaaaagctatataattgtagttataaaaaataatttatttagatataaagatctatctaaaactattaagaataatttttaataatcgatcaactctttatttatcagcaatatacagtaaaaaatcatttatactgaaacaaaaaacaatccataaaagcaaacactgactttcgcattcaaaacgcaaaagcgaagcaaacaacctaaaatatttcactttataaaatcacaatcccagcatcacaaacagagtaaactactcaacaactttccattctgagatttaatttctatatttgggaaatgtccaacaagcacttatatatttatctatgactgatactatttcatatcaatacgctgctccgtctgtcttacaacgttcgtctgatcaggacgaattatttctggcaaaatacagtgaaatagaaaagaaagaagctccctgtttcttttgggggaagctgacacaaccttatatgacggcacgctgcctcattgcgttgtccaacgtggtacaatccagttttaatctgactcctgcccagctttccatgctgaaagacccgattgtgacggcaggaaatgaacgtttacgcttcgaaggattttcgaattgtgcaggcgtatatgccagagtcgatgtactgcccgacggacacgacggagagttcctggagaacggaacaacgaatgttgacttcaatgccggtatgatttctgcactgggaagcatcagcaaacaagaaaaagtagtgatgtcagtcggacctaaggaggtagggctttacaataaaggtgaaaaagtaatagaacgcaaagtaccgctgcccgtaaaatggataaaggggctgaccacggtacagatttaccagtctgttgccgaacggatgtattcattcaatcgtatacagactttgcaactctttcagacactccccaaaggaaccgtgaaatgtgactattatttggtgatgcgcggacaaaaaccggccttttcaccggtgaaaagtctgaatgccgtttgtatcggaggggtacatcgtctgcgcctgctcgaacccctgttgccgtttgccgacgagctaagagtctttgtccatccgacaatgcaatcgaccatctggcaactctatttcggtccggttcgtttcagcctttccctgtcgcgggaatgttggcgcggattctccggagaaggtgcggcattggatgctctgcttgaagacgttccggagaaatggatagaagcgatggataaatacagttacgccaaccagcagttcaaccccactcttttcgctattgaggagcacattgatctcgataaggtggattctctgtctgcacgactggcagctatggggttactgggcttcgatctggatgataatagtttcttttatcgtcgcctgccctttaagacagagcgtatcctgagcctcaatccgcgtatgatagctgccgagaagctattggaagaagagaaagtggaaattatatcaaatgacggaaatcggaccgaagcacgtgtcgctgggagcggaggagtaagacatacggttattctggacagggaaggtgagaaagaacgctgcacctgtacttggtttagcggcaatcagggagaacggggagcctgcaaacatattttggcagtaaagaaacttgtacaatggaagaactgaaacgcgagttggagaaattatccaaaacttatgtggatactccggagaaagaagaaaagatattgataccttttatcaaaaggttgttagaactttcagtgaaagaacggagaaaactcctgcccactatccgggaactgcaatggataaaaggcaagtttagtgaaactttttgcgatcatcaccgggcacgctttctgggtgccgtacagttcgtatgtggcaacaaacgagaaatggacctgggataccacatagacttcaacttactttgcaaattgctttctctttatactcccagttggctggcagagtatataaatgatgcggaaagttacttgaatttcaatatatcctacgaacagctcatgcagctgatagatatgggctatatgcaggaactctctccaaaacgtatcgcacaaatattgcccggttatatctgtatcagatcttccattcctaaagggaaagacacttttaacagcgatttactattaaaaagagaaatcaccctgaaagaacacatttggtatcttttcgaactggaatcatccattggttatcataatgaccgcgcccaaacagcctataaagaagggaccacctcacgggatgaaagctttagcgccgccttctatcgtttttctctcgacggacatctggacagaaaccggcttctgcgagcaacactttccaccttcaaccgaagttttaaaaaagacatggtaaattggtttgccggactctttgaagaattgcagccaagggttgaagaactcatatccctgcaagaggaaattatgcaagtgttcacctctccatacaccaaaccggtgaatgtgatgttacagcaattaaaaaagattgcttccgaaggcgaattccgctatcaggagtttatcgagcgtgcgactactcttttcttttccagccccaaaaactcactgcttactatttattccatttttgagcagatcgttgccgggcaccccgaaatgaaagaagcgtgttgcatcccactctgccaactattcctgaagaaagatgaaagcctgcaaaagaaagctgccagctttatatcaaagtacggagacgcatcctcttctacattgcaagaggcattgctatcttaccaacccgagatgttccagagcgtacaggatatacttgtttctttcatgaagcagcctgcggaagaagccggccttcccgaaacaaccttccaagaaaaggttcgtatttgtcgggaagacaaccgcatcccgtttcctgccaataaagaagattttctgttccagctcagccgcctgttcgacatgaatgaaagttgggaaacagacacagcgattgccgccctcatcgccttccatcctcagttggatgaagaagatttcagccggatggagcctgtattccaacgggcagccaacatcattatcaatagttgggcggtatacgagaactttcttgccactttcctgctggaatatcaacgtttatggacacaaaaagacactgccaaccaaggattcctaagtaagctcttcacccgcctggaagaaagactcaaaggaatagacgcaaacagaggtgcctacgacgaacgtgctttcaaacgtcttgcagactggcaaccagcctacagcaatagaacttgttttgaacctatcaaacaattgtggctggaagtaatccgtaaaatccaaaaaggcgactcattacctttactctctactccgacacatagcccggcatacatccaggccaccgaacttgtacgacggctcgccgtttatcaggaagcgaatgcaaagccttgttcatgggattttcagctggccatagcacgctgcgctttagaagacaaggaagaagccattgctgtcgcccgacaattattaaataatgaatatctgcatctttgtctctttttattagataaagggacgcagcccgaaccaccgtacaatcatccatctgcctggcttgcagccggactggtgaaagagccggatactgaattcgaagcattcaaaaacttctcctgcaatacgctgccccacaattacctgacaggaaattatggctggaaagaaccggcacagaaagaaaatcaatatgcagcagatgtacgtctgctccagctcgatttctacaagtggcatgagtatgcagaacacaacagccaccagctttggcaagaacatctgatcatcaacagcagatacaatataggcgattccgactatatggaacgtctgttcagcttcttccccaaccaaccggaaccactggttgcacaaatcatcaactgctacatggacttcggttcaccgcaggaagagagcaaacgcagtgtagccaatgctttacgtatgttattgtcttttcactgtccgctccgggagatgagtttactgttgctgggcggaggcctgctttttactgacaaaaccgtccgttcatacgctgcggagctatgggtggaaggcatcgctaacaacagaatagacaatcaccggttaggagaaatagtagcacgaattatcaatatgggcattgttccgctaaaacgcttcaccacagaagtgtatgaaagcatatacaaacgaagcacctttcacaatcaacaactggaagagttactcactgtattgatcggcggattgcccgacaatccggtcaccggacaaaaacagttactcgaactctacgcggaagtacttcgcatgaacggtcattgcgtaactgacgaaaaagtccgcaaacgcctggaaatgtggaaaaagaatactaatctaaaaaaagtagttactgcattagaaaggtgataagtaataggtaacaggtaataagtaataggtaatattgcttggtatcagttttttatcatttcaggtgatcttaattgatttaaagtagactaatttataaacacggatattgttatcatatatccttcaatcaaaattataaccatgactgcactagaaacacagcttaccgagatagtagaaaaagagcaagggcagaagatcattccttttctgcagaaactgacacaggaggagcggaagagcctcatcccttgcctcagccggttggaagaatactataataagtttgtccagctggaagaaaggacatatggtacgcgtgccacgtcgggccagcatcacattattgatcttgccgcccttgtgatatttcccctcaaggaatttcgcaaacacgaatgggggataaacacagcgcatctgaacgagatagccgcatggcatattcccacgtggctggacagttatttcgttgaaggtgaaggtaaggagttcggaggcttctacaatatggactatgagatattgatggactggatagaaaggggaattctcaccgtttccccctctccacagacgatagcaggttatctggttaactatatccacactacccccgtattagaaaagcgggatattacaatcaacgagcacatctggtatttgtttgaatacgactgcgggcaaaactggcacgccaatccggccaaaggatatccttattatacattccagcacttcaccgagaacggaaagttagaccgtatgcgtgtactgaaagagtctttgctggcaatcaaccggaacttcaacaagaacctgtgcagctggtttgccggtatgtttacggcactcaatcccagcgttgaagaacaactgacattgcagccggaaatgtttgccgcactatcttctccccatagccgtccgatcaatatcatcctcggtcttctgaagaatctgtgcagccatccacggttcctgacagatgattttctggatcagaccactgtcctcttcgcttcggacgtaaaagctgtccatcaaaacacgctgggagttctcagcaaactggcgaaagagaaaaaagaatatcatgatgccatctgttgcgctgccacacaagggttgatgagtcgcgacgaatctactcagaacaagatagtgaaactgattcaaacatttggagaaacagagtcgcccacattgaaagaagcactctctgcttatgcagaaacaatgctgaccagcactaaaaaagagttggcagcttatctgaaagacaatgtttcagatgctttatctaccgataaagtcttgctgactactcttgacgagcaggcaaatgtcgcctccttcgactatgaaccgatgccacccatccttcgggaagacaaccggatacaggaaattacttccatcgaagacctgctatttctggccagccaaatactagattccaatgagctataccacttcgaccttttcctgaatgcgttggtagaatggaatgagcaactggaagcgaaacatatcacccaatggacacctgttcttcaacgtgcctataagttacttatcaatggcggaagttcacgcaacggaatattggattctatgatggcaacgttccttatcgactatgcaaaactattaatcaagcgtttccccatagaagcaaaagaactgagcaccctgcacgagaaaatggtgcagaaagacgaacttcagaaaggtcagtggagatatcgcaatctgcagaaaataaccatccgccagaagagtaataaaagaacggaattacctattcacaaacaattactgtgccggacattagaccttttggaaagcaacgagaaccgacttcccatgctatccactcctacgcatacgcctgcatttattgaccccatagttctgataaaaagactcggacaatatcagcaggccaatgccgagccggacgatatggatatgcagatagccctgtcgaggatggcattgaatgattatccctcgcaagaccttccgactgtccttcaggaattggaaggggaataccaaaatttgttttccttcttgatgggagcaaaagatgcagttccacaagctcccttcgcccacccttcatggtggatgacagcaggattgatcaaatcaccggagacggtttatactgaatttaaagatttctcttatagcaaaagctcacgcgaatttctgacgggaaacttctcatggtggactttccaaacgcctcattcatatactgattatcacaacaaagtggtcaactggacatcttcaacccttagtttcaatgttccggaaggagagaacatccacatcgtcaacaaaggaaagtatgatgagagagtgaattatcactcgtatgacccgcatccgctactggtggaaatgtattcacagatagaacgttatgacgatatacaaaacgatctgccccgccttgtatggctagctcccaatacaccggaaccattgtttgtatggtgcatccgctgtgccatttatgatccgatgctaaatgaagtgagagaagttggtatcacccaagccactatagaggcacttcaccaattaaggcacgaatggcatgagacctcttatctgctggaagcgagttgtatgctggtagccgacaagacttcccgttcttatgccgccggaatatggacggaccgtgtcaacacaggatgtatagacagtgcacgtatcggcaggatactgggttcgcaccaacgtaccggatggggacctctgaaaagacttaccgacttgatacaacagcaaatgataaacgtcagcccactacacaaccgggaactggagctgctacttacatcactgattgccgaacttccggaacagcctgtcaaggaactgaagaagctgctggaaatatattcggaactgctgtctgtcaataacagcagagtaacggatgaacgtattctgcaactactcgaaatatggaagaatacggccaatctaaaaaaagtaatagtcagtatcaaccgctgaaaatccggataaatcacagaagaaggtgtgccggtattcagactatatttgcatatagggtatagttaccgttcatgcagggtatagtaacctaacatgcaggatatatatgtccaacgtacaggggatatatatccaacacgcagggcatatatgtccaacgcgcaggatatatagatccaacaaacagcgtaaaaaaggctttttattggtgctaaattcaaaaagaagtatctttggcacacaaaacccaaaggagtaatgatgatgctgaaatatagtttatctgtcttttgctttctgctggcagggtattcctgtgtaccggggcataaggagacgaagacatctgcaaaggtcgaaacaacgtgcacagactctatatgcgcaggacccggagatataagccccgaaggtacagcatccgactgtatatcctttgctcatgcggactccattgatgcagattctatttatacatccccctcgcagaaaaatgaatccgccagcacactggttccaaaacatcagaaaagcccgatggctctttacatggattctctgggactaataaatatagcggagctggacaacagcatcgccatcagcctaatgtacacaaaagcggataacttcaccggagaaattctttatgacaacctgtccgaagcctatctgcatcctcatgcggcgtatgccctcttaaaagcacaagaagcactgaaggcactgcatccatcttacagtctcattatttacgacgctgcacgtccgatgtccgtacagagaaaaatgtgggatgtggtcaaaggaacttccaaatacagatatgtctccaaccccaaccgtggaggcggacttcataattacggcctggcggtagacatcagcattcaggactcgctggggcgaccgttgcctatgggcacaaaggtcgatcatcttggagtagaagcgcacatcaccgaagaaggcgaactgatacgcaacggaaaaatcaccaaaacagaacgtcagaaccggatattattgaggaaagtaatgaaagccgccggattccatgcattgcccagcgaatggtggcatttcaacttctgcagccgagaagaagcccggaagaaatacaacgtaataccataaacaagtccaccatataacgccgaatataaacaacctatgatgcaaatctcccccgaaacccagctctttatccgcgaacatcagacggatgatgtacgtgctctggccctgcaagcccgaaaatacccgaatgtagatatgccgaccgccatcacacagatagcaggaaggcaggttgccgccgaaaagattccatcatggagcgacatggatgatatatggtacccgaagcacctatcactggagcaatgctcgtcagaagtcaccgcccgctacaaagcaacccttttaaaaggtaactccctgacggacctgaccggaggattcggaatagactgcgctttccttgctgccaaattcaaatccgccatttacgtagaacgccagcaggaactctgcgagatagcagcacacaactttcccatcctgaacctaaaccatatcaacgtaaagaacgaggacggagtgagttatctgcaagctatgtctccggtagactgcatcttcctcgatcctgcccgccgcaacgagcacggaggaaagactgttgccatctcagactgtgaacccgatgtagccgaactggaagaactcttactgaacaaagcgggacaggtcatggtcaaactctcgcccatgctggacttgtcattggcactgaaagagttacaacacgtacagaaagttcacatcatatctgccaataatgaatgcaaagaattactactgatactcggacaagcatcggtagaagaaatatccatccattgcgtaaatctccctaccaaggggatacaggaagaacagcatttcgtattcacccgcgaacaggagcagtgcagcgaatgcaactataccaacgcactggaaaattatctctatgagccgaacgcttcactcctgaaagccggagctttccgcagcatcgcctccgcatttcctgttaaaaaactgcatcctaacagtcatctttatacttctgatgtgttggtcgagagctttcccggcagggctttccacatcattagtcagtgcagccttaataaaaaagaactaaaagaaagtctcggagacttgaaaaaagcaaatatcacagtacgtaactttccggctacggttgccgaactccgtaaacgaatcaaattgtcggaaggtggagacacttatctgtttgccagcaccttaaacaacggacaaaaagtactgatccgctgtgagaaagcctgagtctgtaatagcattacaacacagccccttcctgcaccattacatcagtatatgaaataggaacgataaaaaaggataaggatcactcagctgtccttaaaatcccagactgaatttcccgaaaaataaatgagagtgaattctaagtcctctccaaacaatatctataaaatcttacccaagtttacgagcccaatgaccggcgaagtcatccgtgcataattggttctccgggtcctgtccaaaccgtacacccttgatctaatcttctataaacaagcatattacatcgatcgatgttgtatttgtgttgtaaaaagaagattttccttatgctttcaattatttttttatcaagaaaatagaggagtaatttagttatagttcagactagatgtatttaagtataattttacaaatgagtgtaatgctgacaataacatttttaataatgacaataagggaaagtaagtaattgaattgtttcattaatttaaatagaatgtttaagagacacttatagcagtagcctaatggagttgtaattttgaagataagatttttgaggaagaaaaataaaagtgctacttgaaataaatggttagattctttttgaatttgctgctgtttactaattgcatatttatagaaatatttcttattcatataacattcatgctttatagaaatagatttttccacattaagagaaaatctatttctataaagttaaagagatattcctgaaaataccaaccaagattattctaacctagctatcccctccattagcgaagccccgcttacttgtgctcccattgaagttggttcactggatttccacatttcaccccaccaataattgcaatacatcgctgggtaagccgcatgattcaaattcatgcgcaaagtttcagcattatttttcagaaaggttatcaaatgtttgcctatagaactagatgcctcgtctaatgcaaggttcactgcatatggaatataaacagacttaaaaatactttggtccatactgctgccttcgtcacgtaaaataccatttcgtaagcaacgatcgcttgtagcggcatagttgatcacttgttttgctttgtccatgtatttactttcttgtgtgatatggtatagttggcgacaggcttctccaaatgttccctgtgtataagtcagaggtggttcctccactcgtccatcggcattatacgaattattgaccacatactcgtacaacttctttgcatcagataaataatttccatcttcatatcgttgatagagtttagcagctaccagacaacccggagaattagtgcaagcattacggtcgttttgggtggtattccatggaagtcccgtacctttatcatctgtccatgctcgagtaataatgtatttgtcgtatacaattttagcggtttgcgcaaatttttcgtcacctgttgcttcggagagatgtatcagagtaaggcaaatccagcacatgtcatcagtaaagtcatttaggaagccggtttcatctgatggattacggtggtaattgttagcgtggttggcataccagcgttcaaaataagtgcggtaagtagcagccaattgcttatttgtgtctttaatacgtttataagagtaaatcactacatccatagcatgcgcttgttgccagtagatataagtcgattcgtccgacatatctttgggtgtactccaaaatgtacctttacttttattcatgaattgctctattaagacatatgtacaactgtcggcaagagttgcccaagaaaaagggacagtggtttcagcaggtgtagcaattactgttactgctgacgaacgatgaccatagttatctattgctatggcagaaatctcatatgttccgtactgtggcaattgtaatgtatagtttccagttttcccagctgctccttgaataatttgtttcccgttatgtgtaccgccattcttttgcaaataagaaagttctacaccgagtaaattaggagtattcggattttgccatgtgatcagtagttgattagcaatctgtgtagattttgcctccaagttagttattggagaaactgttatttcaggttccttgttcctttcatcatttgtctccgagtaattatcgtttcctccttctccgcaggagatagacaggcaaattaagcaaattatgaattgaagtaaataataggtctgtgcgaattgtttcataatataaagctttagaagttgttgaaaattgtttccaaatatttcagtcttgcaatataccaagactttatgtattctgcttcctcttcgggattagcatatccatacatagaatatcctgtccaccgttggcgatctcgttccaatgcgcctgattccacaatctgtcttttatagtaatctactttagaagccaggtttgccgggctgagaacattatctttaaccgccatcaagcgttcgtatatccggcgtttgatattgttcgggttctcgttcataattctctcaaaggggcggaagtatttggaaccggcatcattacggagtattagcccgttgtcaaaaccaagacctttttcgggatcaagcttaatggcatcccaagtgcgtcccagtgtaccatccaagtcccagggctgaataatgaacttgggtaataaagtgagatttacattgtatataccccaaaaaacatttcgtcctgtgttatcataagctgacagcagattaataaagataaaataatcaatcagagaggaaacatccagtcgctcttcatattgggcggcaaattcttcttttgatgctgcagcgaagaactggataagatcggaaagatatttaaattcgatttcacccacctcgtccggataatcggactcaaatccctgccatgcctgtttggagttactatatggagtattgattccttgtaatttacattcatccgtccattctttacccttatagagataaccacctttctttttcattttcaactgcttacgatcgatacgatcgcttaaaatatacaaaccatggtaagctccgtccaagatcatttctacaggatagccatgtgtagcattcacagcctcgggttctgtattactataatataaagtgttgaaatcgttccaaagatcaaaacaaacacgattgcgcattttgctacaatccagccacatagcatccagtatccatgattgatcttctcgcagacctaatagctttgcgtcttgattttcattcgtttgacggtttttcaatttaaaactgaaagacttcttggcataacgtaaagctcctgctccacgaaactcgataccggcatagctctcaaatcgtaagacagagttgttggtgcgccgtttaggatcagtcagcactatgtcacacgggcgtttattctcatcctcaataccttcaggagcagagatctcaatcacgggaacaccagttacaatcaatcgacaagacctaattttatcaatagtattgttacctgcttccatttctatattttgtccgggattcaggctcagtgctatattctcgcccgacttaattttcttatctccgatcttgataaagtcgactccaatgccgccaaactcaactttgacctttgcaggttgtacggcatccatatctataggtagataatacgaattgttcacataatccacagctgtagttactccgtcgatagtcagattcaacaaacgaagataatcttcttctccttctatagacgattgcataacggtaattcctttttcttcttttcccgagatgattgcaatccgtccatttcttggtaaaccggaagtgttttttttgactttgattcgaaccttagtgatacctatccctccggaagaaggtgagagcgtcatccaatcgcaatgtatacttgattgccatgcgccgcctgaagatacgttgacttcttgttcaccgccttctatcgtcattgctacttgataaatggatagagaaaatggtaaagtagtgtacacatcgttttccttatccgaagaacaggctgcaagcagacttaaaatcaataaagccggtagtattttataaagattcataatacagatctaaaatttaaatgtatatcctgcgccaatcacatgtccatttgcttcatcctcatctgcatgattctgatacaaatagtaaaaatcaagtccgtggtgtttgctcaacttccattctacacctaaggtccagcgtgttttgtcaatcgcccctttatcgttaagcaaatgagtcaattcgcacgaagcgtaaggagtgagactgcatttaggtatattgtatgttgcttgcagacgagaacgaagcacgttctttcctttacctttcacgtattcatcgtctttaggactaccatcgtcaccatcaaactttgatacagactgactgggtcgataggtatattgccaacgctcccgaagtgaaaatgtgaatctatttaaactcacttttcccgttagttggaaatagaaacggtgtttgggttgccaatattcagggataacattccctttgtttgtaatttcagaagggtgattataatagatgtaagtgtatgctgttgcggctttcagccagtttgttattttatatgctacacctgccgatcccgaccaacgtcccacttcgcttaacttgtcgcgtgaacggaactctccttccagcgaaatatcaaagtcccggaataatcttttttccatccccacactggtccatagacccaaatcgtctttttgtgcttgtaaagcaaaagatacaagacaaaacaaacctgccaaaaaaagtttcttattcatttccacgtggtattttggttaatgtatcaatcgtatttatctcatttgtcatcggttcataatagattttaagcatggcggcatcgcgaagaaagtcaatgtacccaacttccacccgaataattttcagtccggtacgcgctttaatatctgcaatcaattcttgttcacacgaggatttgataagttcgattcgatcatagagtatcagtttacatgaaacatgctttagccaccgattactctcacacaaccagatacataatacaaacaataaattagctcctattagtccgccatagtttacttccacgcccaacgcgtttattactgatatggcgataatagcaaacagataagtcatctctcgtacaggcatggactcagtccgataacggatgataccgaaaatagcaaataagccgagagcaaatccgacctttaactttacactacccagcagaaatatcatcaagaaaatgctgatacttattaatgtgaaggtgaagtgataatctctccgcttgctctttggataatagaaaaggtggataataatgcctgttaccaaaaagttgaagccaaagcgcagcaataactgcaaaaagtcaccaccgtctatgagtggagtttctattatatcaagaaaatctaattcatccatatataagtatgtttttatattgatcattaatatactcccattttattcagcattcgtaactttggtttcagccgattgcattttaaatgtgacactgtaagtgctgaccctatacaatatttggaaaatccggaagattgtatatgtagtttacgtagtatctctttaataggtgaagaattgtgtccatctcgtttcagctcaatgataacaatgttatccaaacttgatatttttccactttgtaagcaacaaaatgttactcctgtatcaattgtaaggcgctcggttttatgtttattgacaagtgtaatacggcgaaatgagttttcaagcaaaggcagaagttgtgattgctcataccaggcatgttgacgtaaaaatgcttcaccaccgtcttctttgatcgtgtcaatactcccgatgcggattctcttcttgtctgttcttcccttattatttttatttttcacttccaaaaatgtgagatctgaatctacgtatgtgcgtatacggattttctcccgtacgacccgtccattctgatgagttagatacatgtcacgatctgctgtatctaagtaaattgtatgataagcaatattgtattcaccgttcacttcttgaacgcggtagtcatgtccggcagcaagaagtatctcttttaatatttggtaagaggtgacatatttggtatcagtacggttcatcagctttatgccactcatttcctccaaagatataggaatatattccttgagtgtctgcagaatctcggtcatgttaaagatagtattagaataaaaagggaaggtaacttcaaggttaaagtttccttcccttctttttttaaattagcatcgtattagtcccattcaatagcctgatctttatcaggtatctgagtattaatgttgcgctgcatggagatagtaccttcaaaccgaaactttattctggctcccggcgctaaagtataatcttcaaattcatagtcaacatcacgaatcataacggtacgtctcaataaataagggcggacagcatccatctcttcttcgatataactactagctcgggtatttattttaaaaccattgttttcggagttatcacttgtcaactccacaatgttagtattcggaacaaaatgggctatgattttgtagtttctacggtcctgtcggctttcgtcaattgtacctgcatagaagaatatagtttcatcatcaatagcataagttactatttcacttttcaccaatggctcattttctcctgcacctgcatctaccaacttgccttgtaagttagtaccaccgtatgtacccgaataatcattaaaaggcatgacgcggagtaatgctttacgataatgcttacgataattcggtttgtattcaccatttggggcgtcttcaatagtcagcggtaatacccacttatcaactaaatccagtccagtcagatcaaactctatatcaagatagcctacattttctccagctttaatctgcacggtttcagggaaagagtaatgtttagagggcatttccctataccaaaggtcttcgcgactggaaaagcgagctatgtttagtgttcgcaaggtatccgcgtcaatcccaatttttacggttatatcgcgatcgtttttagtcgatccgctgacaaggataggcaatctataggttgtttttcccgtttcgctataagacaggttaattctagttaccccattgctgttaatcggtgctttgaatgaaatatagtgctcaaactgctcctctttccattcgtcattacaggcactgaacatcactaatacaattagtgaaaatagtaaagtatatattcctttcatatttattaccatgtttaagattaatcattgtacgtccagcctggattctgagtcaggcgcttattacgtttcaattcgccatgtgaaatcggccaaaaccacattttatcagagaacgtagcagacaaattccaaacagcaatcggtgtatggaacatttcgcgatccgattctgtcataagtgtattgcaaccgtaaacgggcattgcctcttctacccgtgcatctttccaacggcggatatcatagtaacgctttccttcccccatcaactctatttgtcgttcgcgtttcagataaatacgaaaaacatccttgtctgcatatatattgttatcgaaatcgggtacaccagcacgcatacgtacaggcttaattccttttctcatttcggcaactgaacgatgaatggaatgagtcttagttccatcccaagatggaatatcatatgtaccttcactcacttcattgatagcttcagcatacatcaacaaaatgtccgcatagcgaattgccggctccggcttatatcgaaggttgtcgatactgttattttgataggtgtcatcgggatgcacatacttcatcactcctatacccgtgcgcaaccaaaacatacctgcattatatccatccctttttccgcgataatagaatatttgtttatttctatctgcaatttctttttcattacctaaataccaataagctccgttatatgcaactgaagcatagaagcgtggttctcggtcggcatattgcaaggaaactccggcagcaagtggtttatgttcttctgcagtagtcgtgaaacctgtagcacgcggacgagtgtctaaacgatgattgttattatattctggtacattcgcatattcagagttcatacccggacaattgcttccgtcgttcatatagtaagcatccacaatcttttgagtcagcccacttgtattccatccggtagcggtaagtggtaactggtgaaccaccatatccctgatactttgccctccaatatttctaccccggctaaaaattaattcaggattacttaatatatctatttgaccattgaatacagaacggtaagattcgaacgggtcaatgtctttccaaccttctggataattggcattgctatatacttcatgatatgggggattgattgttgccggttccgctggcgaatctgttgtacgtctatcagccgtatataactcatatacccctaaatccatgacatctttagcggcagcagcagcttttgcccatttttcttcgctatattcaggagaaagcaagcgattgcctttgtcatctaccaatagttgggcgaattcatcattgttaccattagctagtgggctggcagcataaatcaacgctagtgcacgagcagataaagctgctccacgagttgggcgggcagcagaattctgacctcttgttagagccagatccttagctgccaaagccatttcctgactgatataatcagcaatctcctcataaggtgcacgtggagtagccagttcatcgtaggatgcgtcataatcaagtccgttatctggcaataaaggtaccggaccatatctacgaagcaataaccaatagtagtaagctctgacaaagcgggcttgtgctttatagtcaagccgttcggcttcactttcaaatttatcgttcatgtcgacatactgaataaaaatagtagcttgtcggattccctgataacatctttcccacataccttgtttagtattctcatcatacaatccttctttaaattcattatatgacaattcaccctctttggattcttgtatggaaccgtcatcatcaccgtaatacatatcatccgcaaaacaatgtggagtgactcttttgttacaaacatcagcacaagcatcgcttagataactgaacgcatttgctaaccaggcttctgttttatctctgtccgtaaaaactttttcgatggtttcccgatctctaaaaatatagtcagagtctaaatagtcagaacaggattgtatgcttaaccctaaaactgatatcaatagaatatatagttttttcttcatgttgtttattattttataaattaacacttatacccatagttatcgattttgttaacggatatgattcacctctgggatcgcccatttcaggatcccaagtcttgaaactagaccatgtcaagagatttgttcctaccaaaaaaatacggatattattaaagtgcatcttgttaacaattgatttggggagtgtataaccaacatcaattgtttttagtcgaaggtaacgaccatttttcaaccagaaagtagagtttcggtagttattattgctggcattgtcaccttggtagctcaaacgtggatacgaagcattaggattttcattggcaggaatacctaatgtttcagctgtatcagcatctacccatcggttgtccagcatacctttaaaaatatttccccattcgccttctgtaaaggcccatacacacttgccataagtgaaaaatgttgatttacctgctccttgaaagtggacattcacatctaaacctttccaagaggcagatgcacctaaaccataaatcagatttgggcggctagttgcaccgatagctacctggtctccatcattgatcacaccatcaccgttaacatctctatacttgatatctcccggttgtacctttccccaactttgtgtcgggctattgcggatatcatcgtaatctttgaataatccttctgcgattaatcccttgcattggtccacacgatagcctctttgcatctgataggcatatacattattctcctcatctctttccagtacttcatttttactataagtgatattgccacgtacagttaagttcacgtcattgattctctgtttgtatgagaagtgtccatcgaaacctttagaacttacagcacctacatttgctgccggattatgcccgttcaaaccgacaatctgaggtaagtagttacgaaccatataaattccggtacgtttttcatcgaaatagtcgatcgttgcagtaaatttatcattaaacaatgcaaggtctatacctaagtcattcttttcagcaacctcccaagtgataccattggaggctacatctgcaaatcctaaaccaccaaacgaataacttgaaggatattgtgcccaatcgtatcctccataaataatctcattatccccgtttttataacggtctgcaatagtataaagataggggaatcgcgttccgacattatcattacctactttaccataagagaagcgaactttaaacatattcatccatttcaaatgttttttgataaacggttcttccgcaatattccatgcaagagaaaaagcagggaaaaaaccaaaacggtcgcctttggcaaagttttcacttccattatagccaaaattaaaatcaataaaataacgataattccaattgtaagctacacgtccggccaaatcctgattacgtttgttaataccagtcttcaaatcttctcctaaattctgtgtctgaatgtaagagtcttgtgtatactttatagtagcgctagggtgatgagctccaaaagaacgatcccagtttagcatcatgtctaggaattcccgacgattaccgctagaactgctttcctgtttcatgttctgagaaccactgatcttcttccatcttaattcaccagtttccggatctctggcacgttctgccaaccattgttctggccacttcagacgacggatcgtattttggttgttgctgtcatagccaaaacgcccaacgaactttaatcctttagttatgaaatcaaaattttgttccaaagaaatatttgtttcaatattatttgtccaattttcattgaatccagtttgggttgcagctacccatgggtttgttttattgccggatccaatagctggtatatatccgttggaatacataacaggggtcttaattggattatatccgaaaagttccccccaaacatcaccatcacctaatcccggactattacgtttggataagaatcctgctaccccgactttcaataaggttgtttttgtaatgtcaatatcggtattcaagcggtagttccaacgatggtaagctgcattggtattataatcatctttcaaagattcatctgtattatacataccatcttctttcacatagctagcagaaacaaaataacgggctgttgttccacctccactcatatttaagttaatacggttactccacgcaccgtctttgagtaacatgtccatccaatccacattcggataaagatccgtatccaagcctaaacgtaagatgtccaactcttctggtttatatacagcctcgttgttacgggtaattcgcgattcgttcatcaagctggcataagtaaatccgtcttcgaactttggagttacagtcctcgtattataggttgtttctactttagcatcaattttgattttaccggcttttccgcgtttagtagtaatcaatactacaccattagcacctttcgaaccataaatagcagtagccgaagcatcttttaatacagtaaacgtttcgatgtcttcgatattgatttcatccatactgcgttcgaaaccatcaactaatacataagcagatgagttggcaccaaacgtagatataccgcgaatccagaactcagatatatttttacctggctgtccagaagtctgacgcgccataatacccggtacattacctgccagtgcattgacaatgctggaagatggattacgtttcagctcaccaacatctaccgttgtaatagcacctgtctgtgttagttttctctgaactcccgtaccagtaataacgacttcatctactgctcttgtcacgctttctttcataacaacgtttattgtacgttgttctttaaccattacttctttcgattcataaccaatataagtgaacactaactggcggtaaggttccatggttatggagtaatgaccgttcatgtctgtgattgaacctaaaccgggcatgtccttcacggtgacattcacaccgatcaacggctctttggcttcgtctgtaacaacacctttcacaacaactttttcttgctgcgccataaccgttgaacaaaggcacaacagcatgatacataatgataaatattttttcatattattcatgtgcgttttaatcattagttattcttctccttcgtaagcaatcttacggatacgccgattggaaccatcaccgatgtaatacgtatcggttgcttcatcgtaagctatacctttcggacggtcgaaacgggcctcttgacgtaaatctccatctacatatccccatgggttaccattcagactggcgcttccgcgaccggcaaatgttgagacctttccttgcggggtaattttacggatacattgccccatcttatcacaaagaataaaatcgtattcatcttcttgccctgcatactctgggttctttacgaaaactccttgataaggagtattaaaacgtgcgcttgttccaattccgtctacataagcagctctttctgctgttcccgctacaatgaagggagtgacaaatcgtttacttgcccaatcataatttgtgcgctgaatatagtgtttgttaatagacacaatataagcataattccctgtcggatgtatacggatattatattcccatccattatccatttgaaaaagtacttctttatcagcaggagttgtacgtgtaccgtcgaaaatttcttgaatttgttgcttctctactttgaagaattgccccttatcccaactattaaagtacatatcaccatctaccggatgaaaagttactgtattacaagctttgaaattaaccaacgctaatctgtttccccacattttataattgcgctcatcgccctcaggggcttctctattacgtgtaaaaccatatacagctgctctcaattcgtctccttggtcaactgccacagccatgtgattttcatcaaaaaaggcaagtgcacgtccgcggttagtacctcccatgtcaccttctgtaagagccgttcctacatattggtttttgaggtcgagaatacgcatattaccgtttccttcattttcatcacctgcacctctatcggctgcaacgtacactaagtggggatatttagggtcaaattctaaccagttgggggaaccaaatgcaccacaatcattaaatggaccatcttttgtatcgtatccgccgtcatctctacgcgaaccacataatgtactcactaactgttttcgcacatattcgaacttggcctctgcgatagtagatactaccggattgtcgccattggatatttgtacttcgatttctccggaataagcctgtgaaggtaccaaacagtagatagaatgatttttcacattgattacgatagctttttttccaccaacaaagacattcacaatagacggatcattaccaaaattttctcctgatataactaatcgctgcccgaatccccccgtagtcggattgataccacttacttgaaccggaatattcggatcaaatgctgcattgtctgaatctccgttgctgtcattgtcatcactacaacttccgaagaatagagcaactagcagtaatgccatccagcatacccgccagtagtctttcatgattttgttttttttcatacgtaaaaaattaatgattaataaaatattatattgttggttcattacttatctcttgttgtattatgctgaaatgattcatccatgcgaaaaagtattctttcaacttattgtccatatttttaatgattcatcttatccattaacacttgtatccaatatcctccaattacggaacgtgccttaaatccggtcattctgccagttttggtatcatgccagtcactgataggcacacgtgaagtagtttcattgatgtatttataaagaggatctacaaacttctcaaaaatttcacggtttggagacatggctgctgtccacataatccagtcggattttgtgtaatctctgcgggaatctaatggcaatccatatagattctgctttgtcagatagtagttgatttctttactgattacattattagggaatatattcaaattccacatcttatcccagataatattatacttttgactccaggtattattgcggtcgaaagcgaggcgataatggtcaccttcatttgccatttcttcccatttcatcgccatttttttagctatgtcagcgtatctttctgctacactgtttaatccgagtatatgggctatttcactatatccggctacacccataatcgcttttattgaaagattggcattatgagcccaatggcctgcaaaatcatctgtacaaagttgattttccgggtcctgtccaaacgacccgcaaacacattaacatcctattaattaatgaattatgattgaattgtattgcgtttgtattgtaattctatgtattatacatgaataaataagttacagaaagaaaagaattataggaagtatgagatacttgtcttatatattagaatagcagttccttatagatttatttaaaaactttattttcatctgtctaaatgctctaacgatgtaagaatgaagcatatctgtttggacatgaacataaactctataatattaccgatagtactttatatggctagatatcagcaacttatagtttcctgtcatttcttggaatggaaactgtcgtttcccggtgagggaacggacgttccttttaatggaaacgaccgttccttttaaagggaactggcgtttcctccgaggaaactaacgcctgttgtcttattctaaaaatggttatagttttatctccctaaggaattcatctggctaatttggcacgcaactcttttagtcttttagcagcctgctgattatccactttaatatatcgcataaacgcagatggacttttatgtccggatatacgcattagttctgctgcaggaaaaccagatagatacatgtttgtacaaaacgatcgccgacaggtatgggaagagatcatttcccatttctcatataccctcttttctcgctctttacctttcctgcggacaacttcaatcttttggctcaattttatcttccgccccaactctttgactctctcattaaacatgtatcgtgggattttaggcaaatcataattatattttttaagaatctcgggcacataatcaatcatgggaatcactacagccttgtgtaccttccgctgtttgagatttatattctcattatccaaatcaatatgctcaggacttaaagttgaaaggtcactgtatcgtaatcctgtgaaacacccggtaatgaatacatcccgtatctcttccaattgcttatcatctgataaatcaagttcgtatattgcagccagctccttttcatttagataaatagcatcggtttcctcttctacaactttgaaattctttaggtcaatcggtggaataattccttttactatttgataattaacaaagcctttcaacaaacgtatgatttttcctgcagaattggtgagcagccctacagttccgtttggttttactactttatgaaatagataatccataaactcgttgtaaaatgtcagattcaagttgcggaatgttacaggttgtgatgagtattctttgaaggcggtcagatgcttgcggagtgttcgatagtcttttatttgatctgcagagacggatggtgctttttccactatataccgttctaatgcatcaaacatatctacccgattaggacgcagatcatattccctgttcttttctaattcaagcaagacaaaatcaactgtcggatctatgccgtttactttagcataggtgagaatatcaccgagcttagatgttatcttaatcaagcaggcatcaatttcttcataatggggacatgcacgcttaatccatttcctttttgcatcccaatgttccggtttgatattgtatccggtagagataagcgtgcgcttgttccgattgtaattatatcgaacataaaggacagtagttccctcttgggtaacgtacttgggtttaatatatggtatatattttgcgatggtataatcagtattgcattcgtgttgcaaatttacgaaagctatctgaaatgaccaatatctcttttgttaaagttagaagtcatcaattaatagaccttcattttgggttggtaaggataaaatctgctcaaaaaaggataaatactgctcaaacaacgtcagagcccctattccgtatgttaaaagaacgtttgaaatccaaaaaagaatagattttgtcctttcttgaacacagattttccttgtttcttctattaattccattattttgtgtcatcaagatgagatactatggaaaataaagagtttgttaaagctcgatatttgctagaaatacacgatttgttagccgcttctccataacatttcatcctaaatatgacagtactgatattatatattaaaggtataggaaaacgggtataaagattgcaattattcaaaggtgagatagtattaaggtaaaaagtggatttaaaagaatacttagggcttgtttttttatgaggtaaataagattgatggatggataaccttggatttgaagattaatttaaagcaaatatttatgaagaaattgctagccataatggctctttcagtcggcttgttggcaaatgcccagaccgttgacttattaaaacctgcaaaagatatagtgctacgtgctccgtcggtgcctattatcgtttcagatccttatttttcgatctggtcaccctatgataaattaatggaaggtagtacagagcattggacaagtgcgaagaaacctttattgggtgctctgcgtgttgacggaaaagtatatcgttttttggggaaagataaaattaatctggtacctattgctcctatgactaatgtagaacgttgggaagcagcgtacactaacagccaaccatcaaacggatggcaagaatttcagtttgatgatagcaattggaagaaaggtaaagcagcgtttggtagtcgtgatatggaacgtattcacacagaatggaaaggagacaataccgatatctacattcgtcgcactttcgattttaatgaaccgaatatcgctgaagatatttatctgatctattcccatgatgatgtatttgagttgtatctaaatggggaaaagcttgtttctacaggacttgtctggaagaataatgtatatctgaaactttcagaagaagcaaaaaagaaacttcgtaaaggtaagaacgtaatcgctgcccattgccacaatactacaggtggttcatatgtcgatttcggattgtttcgtgagaaggaaaatgctgttaagtttgcaaatgaagctgttcagaaatctgtagacgtattggctacttccacctactatactttcacttgtggtcctgtagagcttgatgtcgtgtttaccgctcctcaattaattgatgatcttgatttattgtcaactcctataaactatgtttcttatcatgtacgttcattagataaaaaaactcatgatgtacaattctatatggagacaactcctgaactggctattaacgaaagtaaccagcctactgttgctcgtaccttatcaaagaatggtatcagttatgtagaagcaggttcaatcgatcaaccaatatgtgaccgaagaggtgacttgatttgtgctgattggggttatgcatatcttgctagtacgaatggatcaggtaaatcagtcagtttgggagactattacggaatgaaagaatcattcgtgaaaaatggtacattagccactacaaagactaaatggacaactcgtaaagaggaagataatccggctatggcatatgttcacaatctcggttctgtctccaatagcgggaaagaaggattcatgatgcttggttatgatgacatttactctattgagtatatgtacgagaagcgtatgggctattggaagcatgatggcaaagtgactatcttcgatgctttcgaaaaattgagagacaactatcaggctattatggaacgttgtcgcgcctttgacgaacttatttatgacgatgcagaaaaggcaggtggcaaaaaatatgcagaaatctgttcggcatcttatcgccaagtgatctctgctcataaactctttactgataaagaaggtaacttgttatggttctctaaagaaaacaacagtaatggttgtgtaaatacagtagacctaacttatccatccgcaccactatttttggtttataaccctgaattacagaaagctatgatgactagcatctttgagtatagtgctagcggtcgttggaacaaaccttttccagcacacgatttagggacttatcctattgctaatggtcaagtgtatggaggtgacatgccaattgaagaaggaggtaacatggtaattcttgctgctgctattagcaaaatcgaaggaaacgctgactatgtaaaaaaatattgggatctcttaactacttggacaaactatctcgtagagtatggacaggacccggagaaccaattatgcacggatgacttcgccggtcattgggcccataatgccaatctttcagtaaaagcgatcatgggtgtagccggatatagcgaaatggcgcatatgcttggtttatatgatgttgcagagaaatatgcaggtatagccaagaaaatggcggtgaaatgggaagaaatggcaaatgaaggtaatcattaccgccttgctttcgaccgtgagaatacctggagtcagaaatataatatgatttgggacaagatgtggaatctgaatttgttccccaataatgtaatcgacaaggaagtaagttactatttgacgaaacagaatccttatggattgccattggactctcgcaaagagtatacaaagtctgactggattatgtggattgcagctatgtctccagaccaagatactttcgaacagttcataaatcctctctataaatatatcaatgaaacgacttcacgggtacccatcagcgactggcatcacacagatagtgggaaatgggttggttttagagctcgctcggtaataggaggttattggatgcaggtattgatgaacaaagtcatgaataatcagtaatttaaatctaatttattatgaatttaaaaagtaacaagaaaagtaagttttggtgtataccatacgtcatgcttacattattagccttttttttaggaagctgtgatgatggaaaagaagtatctcctattacaggtagtggaggaactccattcaatcctgcttttcctattcgtattgatagtatttaccctaaagcaggctctgcagggcaaagagtacttatttatggagagaattttggaaataatccttcccaattggaagtttatattggtggtcagaaaagctcggttgtaaatgtaaagtctacatatatgtattgtcttatgccatcaaaagcctatgaaggtgatatacaggttacgataaaagatggagaaaaaacatatacttctgaaaaatctgatgtgagatttgaatatcaacgattaaaagtagtaagtactttacttggtgaggttaatccacaaatttccgataaaaagaaaaattttgaaataaaagacgggccttttgataattgtggcggtgttgctaatccttgttttatgaaatgggatcctgagtaccctgagttgttatattttgctgaggatacatctgttgaccctgaaggtgttacaggttctggtatacgctgtattgatttcggacggcaacaattatatactattcttcctaggagtgagtatggagggtatgagcgtgggcgttctattgatttttttaaagataaggacggagtgtatcatatggttgtggctacatcacaagctaatgcaactaatcctgcggtctatatgtttgatcgtgtttcagatacaactaaaccatgtggttttaaatggtcaaatagaagaacaattgtgaattacaatggttgcgcatgtgcagcaatccatccccaaaacggtgatttatattttactcattttcagaaaggtcacctttatagagtaaaaaaagatattcttcaagaatttgttgacggaacccgtactacagctgtttcacctgggacaggggcggactatatgtttaccgtccaagataaagaatgggaatttaatataattattcatccaacaggaaattatgcttaccttatggttattaacaagcactatattcttcgttctgattataatggggagtcttttactactccttacgtggtagcaggaagcgctaatcaaaatggatatgtagatgctgttgggaatttagctaagttcgattcggcataccaaggtgtatttgtaaagaatgataattataaaggtgagatagatgaatatgacttttatattgcagataaacataaccatgctatccgaattttaactccactgggacaagtctcaacatttgcaggtcgaggaagcgctagtttaaattctaatccttgggggtatgttaatggggatttgagaaaagaagctcgtttcgaacgtcctaaagctattgcatatgatgaaaagacaggaatagtttatgtaggtgatgcttataatcaccgtatccgtaaaatagctttagaagaatttaatgattaacacactaaaatatgaaaaaattatttgtcttatgtactatgttgctatgggtggctataaacgccttggcacagcaaaagattagtgtctctggtattgtcacagatgagaataaagaaccggtcattggtgctaatgttagtgtaaaagatgtcccagggctaggaacaatcacagatctcaacggacgatatgtaattaaagtggaaccttacaatcgcttggtattttcttatattggttatcagtcacaagaagttctaataaaaaatcagtcaaaagtaaatatagtactaaaagaagatgttaccaatgctattgacgaagtggttattactggtactggagctcagacaaaattgactcagacaggggctattacaacagtaaatgtagatcatctgaaagctaatccgtcttctagtatcgtaaatacattagccggtaatgtcgctggtgttttggcaatgcagacttccggacaacctggtaaaaatgtatctgagttttggattcgtggaatttcgacttttggtgcaagtactagcgcgtatgtcttggttgatggcttcgaacgcagtatggatgaaatcaatatagaagatattgaatccttttcagttttaaaagatgcttctgccactgctatttatggatcaaaaggcgcgaatggggtagtattgattacaactaaacacggtaaagccggtaaaattaatattaccgcaaaagcagaaacgacttataatatgcgtacgatcactcctgaatttgagaatggggtaaattatgcaaattttttaaatgaagcacgtattactcgtaactatgaacccgtttaccagcctgaagagttggatattatccgtcttgggttagatccagacctctatccgaatgtggactggatggatttactattaaaggagggagcgtggcaacatcgggtaaatctgaatatgaatggtggtggaaatactgcacgctattttgtatctttcagttatttggacgaacagggtatgtataacacggatagctcgttaaaaggagattataacacgaacgctgattatcgccgttataattatcgcatgaacacagatattgatattacaaaaagtacacttctcaagttaggagtttccggttatttatccaaaagaaatagtccgggattgggagattctgatgtatggggagaactttttggatatactccaataagaactccggtattatattctaatggctatgtacctgccgtcggtacgggtaataagactaacccatgggtagcggctacccaaacaggttttaatgagaattggaaaaatactattcaaactaatgtaacattggagcagaaactagacttcattactaaaaatctgaaatttgtaggacgttttggatatgacacatataatgataatactatcaaacgtcataaatggccggaacaatggcttgcggaacgagctcgcaatgaagagggtgaattagtatttaaaaagatttccggtgcaggaaatatggcacaggagagtagttcaagtggaaatcgtcgtgaattcttagatttgacgttaaattggaacagagcgtttaaagcacatcatcctagcgcgacattgaaatatacccaagatgcttttgttaaaacggttgctttgggagatgatttaaaagagggagtgagtagacgaaatcaggctttggcagggcgctttgcttataattataactatcgatattttgttgacttcaattttggttacaacggttcggaaaattttgcgaaaggacatcgttttggcttttttcccgcatattctctggcatggaatattgcagaagagaaaataataaaaaagcatctgaaatggatgaatatgtttaaggttcgttattcttatggtaaggtcggtaatgataatgtaggaacccgtttcccatatctttattcaattgccgataactataaagaaaatgatcagacgaaatattatgcaggttacaactgggccacttatggaagtaataaatcttataatggtttacgctatacaaaacttgcttctaatgatataacatgggaaatagcaaccaaaagcgaccttggtatagatatggctttatttaatgacaaattcacagctacgatcgactattttgatgaaagtcgtagtggtatttatatggagcgtgcattcttaccaggaatggttggtctggatggcaataaaccttatgctaatgtgggtgaagtaaattcaaaagggtttgatggaaactttagttataaacaaaaaattagtgatgttaagttcactgtacgtggtaatatcacatatagtaagaatgaaatcatagaacgcgatgaagagaacaatgtttatgcttatcaaatgaaaaaagggtatcgggttaatcaaaatagaggcttgatagctttaggattatttaaggactatgatgacattcgtaacagtcctacacagaaatatggtcctgtaatgcccggtgatattaaatataaagatgtaaatggtgatggtgttgtcaatgatggcgatatcgtagctattggttcaactagtaaaccaaatctaatttatggtttaggtctttctgctacctggaagggattggatgtaagcttacatttccaaggtgccggtaaatctcagttctttacttatggcaaatgtatatgggcttttacagaaggacaatggggtaatattcttaaaggaacgctggataatcgttgggtggatgcggagactgcacaaaagcttggcatccctgctaatgagaatccgaatgcatcataccctcgtttgagttatacggataatggtaatggtaatacaacgatctatgaatataaaaataattaccgtaattcgacatattggttgcgtaatggttcatatgtccgtctgaaaacgattgatgtcggttatactcttccgaagaagatcgtgaataagatacattttaataatgtacgtattttcatgacaggaactaatttactgacatggtccagttttaaactttgggatcctgaaatgggggcttcacgtggtgagcaatatccattagctaagtctataacactcggtttaagcgttaacttataaaattcagaacaataaaatgaaaaaatatatattattgataattataatcggtttcgggactacatcatgttctgactatttggattcagaatacatttttaaagatcgtgaatctttggagaagatatttacagattatgataagaccgaacagtggttggcacgtgcatattcattccttaccgggcaatgctgcgatgtaggcagtaaacgcaatactccgtttgtgtttgacgactgtatgtactatggtgatgatgatgttaccatagacgcatccaaaggtggaaacatgtcatataataagtttcatgaaggagggtatgacgaaggtgctttccaggatacttgggatcgctgttataatggtattcgtcaggctacgattttcatgcagaatgtggatatgaacgataaatataaacctgaagagattgttgatcttaaagcgcaagcgcgttttgttagagcttatttttattggattcttcttcgtaaatatgggccgatacctctagttccggaaaatggttttaactacaatgactcttatgatgatgtcgctacaccacgcagttcttatgatgtttgtgccaattatattgcaagtgaaatggtaatagcagctaaagatttgccattgacgagagagcaacttagtataaaccgtccgacgcggggagcggctttggctacccgtgcattagctctattgtatgctgccagtccgttaacgaatggtaataatgatgaatatgcacaacaattgctggatgataaaggtaatcgtttgctttctcctgaatatgatgaaagtaaatgggcaaaagcagctgctgcctgcaaagatgtaatggaattgaatgtatataagctttataccacaggtatcaataccgtgaatacaggtgcttttccggcaactatagcgcctccacatcacgatgtatattcaaatgaagattttccgaatggatgggcgaatattgatccatacgaatcatatcgtgcattgtttaatggaactgtgtcatcagtagataatcctgaactgatttttactagagggcagaacatcggtggtgaacgcattaaggatatggtaattcaccaactgccttccgttgctaaaggatggaatacccatggaatgactcaaaaacaagtagatgcttattatatgaatactggagacgattgtcctggaatgaattctcagtacgcaggataccaagcatataaggatcgtgtagacaatcgcccgcgaccagtcggctatacttcaaacgcacaggactataaaccgctttctgcaaatgtttctttgcaatatgcaaatcgggaaccacgtttttatgcttctgttgcttttaacggtgccagatggtatttaggaaatgaatctcagcaagcaaatcagaataaacaagtattctactatcgaggtggaggtaatggttattccaataatatgttttggctgcgtacaggtattggagtgatgaaatacgtgaacccaagcgatacttatgaaaatagcgacggagccaaaattattgataaagatgaaccagctattcgttatgccgatattctgttgatgtatgcagaggcattaaacgaattgactacatcttatgaggtttcctcatgggacggaattaaagcttataccattaaccgtgatccggaagaaatgagaaaaggaataaaacctgtgcgtatgcgtgccggtgtaccggattatgatactcctatatatgataaccctgcaaaattccgtattaaactgaaacgtgaacgacagattgagctctttgctgaagggaaacgttactatgatcttcgtcgttggaaagatgcagaattggaagagtcagtgcctgtttatggttgttatacttttatgactgaaagtcagaaagatcttttccatacaccggtacccatatctaatctttcagcaactttttcatccaaaatgtatttctggcctataaaacatgatgaattgaaacgcaacaaacgtttaactcagaatcctggttggacttataatgattaattaaaaaagaaaagatatgaaaaagatatatacttatttgatgatgctaactgttagcgcattaattatctcctgtaatgaagagtggagtggtgaacaatatgaacattatatttcttttaaagctccaataaacagtgatggggtatcacgaattaacgtacgctataaggcgaacgaagcaactacttatcaggtgcctttgatagttagcggtacgactttaaatgataaaaactatacagtacgtattggtttggacccagatactttagtggttcttaataaagaacgttatagtacgcgtatagatctttattatcaggtattaccagctactttctattcattgccggagaccgttgaaataaaagcaggggagaatacagcacttttacctatagattttaagttgaataatattgatttgtcagagaaatgggtgctgcctttaactgttgaagaatcttcagatggtagctatacccctaattatcgtaagcattatcgcaaagcattactccgtgttatgccttttaatgattattcgggcaattatagtgcagtaaattataagtgttatatcaaaggagcggaaagtgaggccccatttgtcaaaaactatgtaatgacttatgtggtggacgatcaaagcctttttttctatgctggcattattgatgaaacccgtgtcgataggaaaggatataggattcttgctaaatttataaataatgataatggagaaatcggcaatgtggaattatctcctgcagattctgacaataaaatgaaatttcaaataggtaaagatgactatgggaaagaggtaacccctacctatagtgtaactgaaacaatggatcctattcgtccttatttgaaacgtaagactataatcattagaaatattaattacacttatgttgactatactacaattccgggggtagaaaccgaatatcatgtaataggttctttggctttagagcgtcagatcaatactcaaataccagatgaagatcaagctattgactgggaggctgggaattaaatagttttgtctattgattaatattggataaattatcaaatataagagatagagaagaacatatgaccggagttcttctctatctttattcttttgtgaaagaaaatcgattatttattagatattgctttttattggtcagaattttgccttttttctatgatatcttccttatttttgtttggaagcaatgagaatggtgttaattaaatcggaataattatgaatataaaaaaacatttaccttggttgggggctttactccctattattaatgcacaagcggatacgaatcccaatgtagttatcatttatatcgacgacatgggtataggtgatattggctgttatggaggaaaatttgtagcgacgcccaatattgataaactggcacaggacggattattgtttaatcaatattattcttccgcaccggttagttcaccctcccgttgtggattaacaacaggacttttccctattgaagtaggaattaatactttccttaacgacaaggcaagtaataagaggtgcgagcagcgtaattatctggacgacaaacttccttctatggcacgtgcttttcagaatgcaggatatgctaccggacacattggtaaatggcacatgggaggtggacgtgatgtgcacaatgccccttctatcaagaactatgggtttgatgaatatctttctacttatgaaagccccgatccggaccctgcgataacagcttctaagtggatatggtgtgataatgacagtataaaacgttggaaacgcacagaatattttgtagataagagtattgactttattaaacgtcataaagatagtccattctttctcaatctttggccggatgatatgcatacaccatgggtaccggagtttaagcaaaaagaaagaaaaagctgggagacaaaagaggcgttttcgcctgtgcttggagagatggacaaacaaatcggtcgttttattaaggcactggatgatatgggattatccgaaaatacgattatcatctttaccagtgataatggacctgcacccagtttcaaggctgttcgctccgcttatttgagaggtaccaagaatagcctttacgaaggaggtatccgtatgccgtttattgtcaaatatcctaagaagattaaacccggtcgggtgaataattcttcagtgctatgtgcggtggatttatatcctactttatgttccgtggccgggattaaaactgagaagaactataaaggtgatggacagaattatgcaaaagttttgctcgggaagtcggaggcaaaacgaaaaacggatttaatgtgggactttggtcgaaataagcattttggttttcccggcaatccttacgatagaagtccgcatctggcaatccgtagcggcaagtggaagctgttggtgaacggagacggaagcgatgcacaactatatgatatggagctggataaattcgagaagaataacatagctggcgaacatccggaattagttgcaaaactaagcaagaaagtatgcgaatggtacgcccaaaacaaagataaaggattgcaaacagacctctaattaaaaaaaacatgaattcaaaagcttttcttttgccggcagcactgatgatagccggcaattccgttgcaaactcaaaagggaaaaaaactgataaaagacccaatatactggtgattcttgcagatgaccttggctattctgatttaggatgttatggcagtgaaatccatacacctaaccttgataaactggcacaacaaggagtacgcttcaaccatttttataatgcgagtcgtagttgtcccacccgtgcttctttgctgaccggactgtatcagcatcaggcaggaatcggacgaatgacttttgatgacaacctgcccgggtatcgtggcacactttcacgtaatgcggttacgatagccgaagtgctgaaagaatctggttacactaccagtatgatcggaaaatggcatgttgctgaaactccattgcgtaaagatcagcgtgaatggctggcacatcatgtttaccatgacacctattcggatttatgtcactatccggtaaaccgtggcttcgattctcattacggaactatttatggagtagtagattactttgacccgttcagcctagttgaaggagaagtacctgtaaaagaagtaccggaaggatactatatcactcaagcactttcggatcgtgccgcagaagaagtaacggaatatgccaaggatgataagccgttcttcatgtatttggcttataccgctccacactggccgctccacgccttgccggaggatattgaaaagtataaggatacgtacaaagtcggttgggaagctatacgcaatgcccgttacgagcgtcagaagcaactgggaatatttccgggaatggacgattttttgtccgaacgtcagtttaaagacagatgggaggacaatgctcatgcggaatgggatgcccgtgcgatggctgtgcacgctgcaatgatcgatcgtatggatcagggaatcggacaggttattgacgcattggagaagaccggccagttggataatacactgattcttttcctctcagacaatggttgcagtaatgagaactgtcagaattactctccgggagagaatgaccgtccggacatgacccgtaagggagaaaagatggtatatccccataataaagaggtattacccggaccgcaaacgacctatgcttcattgggtgcccgttgggcgaatgtggcaaacacacctttccgcttttggaaagccaaatcctatgaaggaggaatctgcacaccgatgattgcgcactggccgaaaggaattaaaaagaatgtaggcggtatgacaccggagataggtcatgtgatggacatcatggctacttgtatagacatggctggagcaacttatcctgctaaatacaaaggaaacgatatcattcctatggcaggcaagagtttgcttcctattttcaaaaccggtcatcgtgaaggacatgattatctgggcttcgagcatttcaatgagcgtgcattccttgccaaagacggttggaaactcgtgcgtccgggcgagaatgccaaatgggaactctacaacttgaatgaagaccggagcgaacaacataatctagctgataaatatccggagaagaacgaaatggtgaaagcgtacgaggaatgggcgaaacgctgcatggtagaaccctatccgggacaaaaaaagaaataagagcattatggtaagaaccaacttcttaatgactgcccctttattgatggcatcattttgttccgcacaggagaaaccgaatgtcgtactgattctggtagatgatatgggttattccgatatcggttgttatggtggcgaaatacttactcccaatattgatgcgttggcgtctaaaggtgtacgttttactcagttttataatacttcccgttcttgtccggcacgtgcaagtctgatgacaggcttgtaccagcaccaggcaggtattgggcagatgtccgaagacccttttgcgaatcctgaccagaagagtcctaatgattggggagtacaagggtataaaggctatctgaacaggaactgtgtcacaatagccgaagtgctgaaagaagacggttaccatacttatatggcaggtaaatggcatctgggaatgcatggagaagaaaaatggcctttacagcggggctttgaacgtttctatggtattctttcgggggcatgcagctatcttcgtccatcgggaggacgtgggctgacgctggataacaccaaacttccggctccggatgcgccttattatacgacggatgcttttgctgattatgctatccagtttgtggatgaacaaaaggatgaccgccctttctttctctatttggctttcaatgctcctcattggccgctacatgcgaaagagaaagatatacagaaatttacaaagatatatcgtaagaaaggttgggatgaaattcgggaagcacggcgtaaacggatggcaaagatggggattattgattcaaatacagactttgccgaatgggaaaaccggaaatgggacgaactgacagaacaggaaaaggaccaagtcgcttatcggatggctgtatatgcagctcaggtgcattgtgtagattacaatatcggcaaactgattgattgcttaaagaagaatcataaaatggacaatactcttattttgttcatgtccgacaatggtgcttgtgccgaaccttatgaagagctgggaggaggaaaggtggaggaagtgaataatccggcttcgagttttgcgccgacttatggcagggcgtgggcgcaggtttctaatactcctttccgaaaatataaatgccgtgcttatgaaggtggcatttctactcctcttattctgtcgtggaaaggagcattagggaataagaaaggtaagtggtgtcgtgttcccggatatttgccggacatcatgccgactattttagaagcaaccggagctaaatatccggagacttatcatggaggaaataaaatttatccgttggtcggcagcagtctttttcctgctgtccataagaaaacggactccttgcatgaatatatgtattgggagcatcagaacaacagagcgatccgctggagagattggaaggctatccgtgatgaaaaaggcaaggaatgggaactgtatgatgtcgtaaaagatcggacagaacgctttaatgtggcagaacagcatccggaagtattgacaagattggttacggaatgggagcgttgggcgcatgcaaactttgttttaccgaaacatccgaaaaaataaaagaaggacagataatgaataaactgatcttgggggcgtctatggtagtaagtgcaactacattgtcgtttgcacagcaggtagaacgccctaatatcgttattgtacttgctgacgatttgggatggggagatgtcggatttcatggcagcgagataaaaactccttgtctgaacgctttggcagcagaaggagttgtactggatcggttctatacagctcctatcagtacgcccactcgtgccggacttatgacagggcgttatcccaatagatttggcatacgtacaaccgttattccgccttggcgtgaagacggattggatgaaaatgaagaaactctggccgatatgttggcacgtaacggatatagtaacagagccattatcggcaaatggcatttgggacatacccggaaggtacattacccgataaatagaggcttttcccacttttacgggcatctgaatggtgcaattgattatttcgatcatatgcgtgaaggagaattggattggcacaatgactgggagacttgttatgataaaggatattctactgaattgattacccaagaagctgtcagatgcatcaatacttatgagaaagaaggtccgttcttgttgtatgtagcttataatgcccctcatacaccgttgcaagcgcaggaaaaagatatagaactttattgtgatgactttggtagtctgacaccgaaagagcagaagagagtaacgtatcaggcaatggtgtcctgtatggatagaggaattggtacgattgtggatgctttgaagaaaaaagggataatggataatacatttttgatcttttttagtgataatggtcccgccggtgtaccgggatcgtcatccggcaaactacggggcaggaagtttgacgaatgggacggaggtgtgcgtgtgccggctgtcttttattggaaaagggcggaaagtaactataagaatctgagttctcaagtgactggatttgtagatatcgttccgacattgaaagagttagtaggagataagaatcgtccggaacgtgcgtatgacggaatcagtatacttccgttgttaataggtagtaccagttgtattgaccgtaatttctatttgggatgtggagctgttgtgaacaaagactataaattgatcagaaaagggcgtaagccgggattgaatttgccacaagactttctggtagactatcaaacagacccttacgagaaaaagaatgcttctaatggaaatgaacagattgtgagatctttgtatcaggttgctctgaaatatgataccattactccttgtttacccgagattccttatggtaaaggacgtgaggggtttaaagcacctgtggagtggaaagtaacacgctgaatgaatcgggccgaggcattccgaaatgcagggtatgtgttattaattcgagagactactcaattataagacagcctctttattatatttacatatctttcaatcccagaacttgtgtctcaatatcatatttagacatttctttttgttttaaatgttccactttctccatgaaaacagtatggctatagttgttctcaggaactcgtttaacttcagcaataagagctttcttaccactggatttaagagcaacaatatctatttcataagaatttattcgttgtttgccaatagaactttttgtttcccaccaagagcctatttccttgaaacctccggtttctgccagtttctgtttgaagtatttctctaacaccctacctgaataggtcggataatcagcttttgctaattgtctcaaatcatcaaaattctgtaattcaatataagagcgattctgctcaatatatttaaaccagaaattcaagaaattatcaccaataacatatcgtacatttttcttagttccgggttttgcaaaaataggacgttcccgggttattaaattgtatacattctccagtttgcttaaataacctccgatagctgtaccgcccaatgccgattctatctcgccttgcgtatagtgcccgttggcgatttctgacaaaatggaaaaataggtaccatagtttttcccaaactcagttatcaataaattacgtccttcatctataaacaaggagttttccgaaaagacaaagtcatacatcttatctatagtaagcgcttggttatcacaaaacaactctacatatttagggattcctcctgtcaacgtgtataaagctaataagtcatcattgctatatccggaagcaagatcctccattatttgtttcaggacaccgatcttaaaagcacgcagacataaaatattgtcagcacgcccaaataggggttcattatgatcagtgaatattttctgcattaaggagtacacagaaccactgatgaccaaatttattttagtttcttgtttatactcatcccaaagattctgcatatcactaaagacgtcaggtcggatattataaaactcttgaaattcatctatgacaatattaaaagcacgtgttttaccaacttcaaaaagatattgcatcaaattggtaaaagtaggtattccttcaggaacgaatatggatagagtttcacgtactatctttacaaaatcagtaactaatatgctttcagcttttcttccaatgaataaataaactgtaggcgttcctttcaaagcctcctttatgagactggttttaccaatgcgtctacgtcctgtgaccacaatcattctggaattttgagtaaatgcaagctcttgcacacgcttcaattccgcaacttctttttctctattatagaatttcataatgatgatttgttttctcaacggccattgactcaaccgctgttgcgaaaatacaaaataaattgagaacaatcaattttagcatgcaaattatgaatgtttcatcctatattataattctttaagtaatgcagattaagtttctaattccgttataacatatctttctatatgtccaaacatttttataacatgggggtatatgaatcggattagaggagataatgcaaatttgttgacatagtactattgataaatagcataaagattgagttagaacaacacaaatacaatacgttaccgaattaaaccgttgataatatgccgtttacaaccttgctatacggtttggacaggacccggagaaccaattatgcactgatgacttcgccggtcattgggctcataatgccaatctttcagtaaaagcgatcatgggtgtagccggatatagcgaaatggcgcatatgcttggtttatatgatgttgcagagaaatatgcaggtatagccaagaaaatggcggtgaaatgggaagaaatggcaaatgaaggtgatcattaccgccttgctttcgaccgtgagaatacctggagtcagaaatataatatgatttgggacaaaatgtggaatttgaatttattcccaaataatgtaatcgacaaagaaattaactattatttgacgaaacagaatccttacggattgccattggactcccgcaaagagtatacaaagtctgactggattatgtggacagctgctatgtcttcagatttagaaactttcaagaaattcatagatccactctataaatatatcaatgaaactacttcgcgggtacctatcagtgattggcatcacacagacagtggtgaatgggttgggtttaaagcgcgttcggttattggaggatactggatgcaagtgttaatggacaaaactcgatgaaatgtttaattaactatacatttattattaactagaatgaaaaacatgaaatgtaaaatgaaaaaagtattgaaggaatggcggtggatattgctggcattattcacgatttgcatttgtagttgtaaggacgatgacaatgtagagactggagcctttgatccatcaaaacctgtagcaatttctgattttactccgaaagaaggaggagcctatcagaaactattgatttatggtgaaaatttcggaacagatgtttcgaaggtaaaagtgaagattggtggcaaagatgctattgttattaatgtaaaaagtacttatgtttactgttttgttccttcaggagcttttagtggtgaaattgaaatcactgtaggagaaggagagaatgcagtaacaacgactgcgagtactacttttagctatgagaaaaagatggttgtaggtacgctttgtggctatcgcaataatcgtgatgatcaaggttggagagacggaccatttgatggaccggaaggtgtcaaatgctgtggctttagcgataacggacgattagcttttgatccgttgaataaggatcatttgtatatttgttacgatggacataaagctatacagttgatcgatttaaaaaatcgtatgctttcttctcctttgaatatcaatactatacctactaatcgtatacgaagcattgctttcaataagaagatagaaggatatgctgatgaggcagaatatatgattgtagctattgattatgatggtaagggagatgaaagtcctagtgtatatattattaaacgtaatgcggatggtacattcgatgatagatctgatatacaattgatagctgcttacaaacaatgtaatggagctactattcatccaatcaacggagaattgtattttaatagttatgaaaagggacaagtatttcgtttagacttggttgattactttaaaactattaagaatggtggaagttgggatcctatagtaaagaacaatcctaatacttttaagcagttattcactattgctgacccaagttgggaatttcagattttcattcatcctactggaaagtatgcttattttggtgtgattaacaatcattatttcatgcgttccgactatgacgagataaaaaaggaatttattaccccgtataattttgtcgggggatataaacagtcaggttatagggatgatgtaggaactgaggcacgtatgaataatccttgtcaaggagtatttgtgaaaaatccggattatactggtgaagaagagtatgatttctattttgtagatcgattaaacttctgtgtacgtaaagtaactccagaaggtatcgtatcgacctatgcgggacgaggagcgtcaacttccttagctgacggaaaccaatggggaactgatgatggtgacctacgagaagtggctcgtttccgtgatgtaagtggacttgtttatgatgatgtgaaagagatgttttatgtacatgatcaggtgggacatactattcgcactatttcaatggagcaagaagagaatgtagccggtgacgagaatataccggaagatgaatcaacagtggaatctaacgaataaacacatttatcagattatgaaaaaatatttagccatttttttgttgatgctggttgtcccattgacgatttctgcacaacaaacaattaccgtgactggtacggttaccgacacacaagatgagccgatgattggtgttaatatcactgtaaaggatgtagcaggtttgggaaccattacggatatcaatggtaatttttctataaagatggaaccttatcatcgactagtcttctcatacatcggatatgatgatgtggaagtacttgtaaaagaacagcatactgttaatgtaaagatgaaagaatcagaggctagtgtactggatgaggttgtggtaactggtatgggggcacagaaaaaactgacagtgacgggagctgtaaccaatgtgaatgtgggagatttaaaacgtttccctacttccaatatgtctaacgctttggccggtaatgttccgggtattattgcccgacaaacttccggacaaccgggaaaaagtacttctgagttttggatacgtggtatttctacttttggagctagttcaagtgcttatattctggtggatggctttgaacgtagcagtttggatgaacttaacattgaagacatcgaatcattcacagtattgaaagatgcgtcagctactgctatttatggttctaaaggtgcaaatggtgtagtattgattacaacaaaacgtggtaaagctggaaaaatcaatattgatgccaaggtagaaacttcttataatacgcgtactatcactccggaatttgtagacggtctttcgtatgccagtctgatgaacgaagcattagtgactcgcaatttaggaatggcctatcaaccggaagaattagagttatttcgtacacaaatggatccggatttctatccgaatgtggactggatggatttgatcctaaaaaacggagcatggagttatcgcgctaacttgaacatgaatggtggtggtaacactgctcgttattttgtttctgcaagttatacggaagatcaaggtatgtataacacagaccaaacgttacgtgatgattacgatacaaatgccaactataaaaagtggaattatcgtatgaatgttgatatagatatcaccaaatcgactttattgaaactaggtatagcaggttcattagccaaacgtaatagtccaggactggctgataacgagatgttatggggcatgcttttcggatacaatcctattgcaacgcctgtatactattccaatggatatgcgcctatttcccaccgggataacgtaaacaaacttaatccctgggttgcatctacgcaaactggatacaatgaagattggcagaataatgtacaaactaatgttacattagaacaaaattttgatttcattaccaagggattgaagtttgtaggacgttttggctatgatacagacaacagtaactggattaatcgtcatcgtcaaccagatttgtataaagcgaacggacgtagacaagaaacgggagagattatttatgagaaaatgttctccgcatatgacatgacacaatcaagtggtagctctggcaaacgtcgtgaattccttgatttactgttaagctgggaacgtgctttcggaaatcatcatggaggagttactttccgttacacacaagatagtgagaagcggacagtagacattggtacggatattaagaatggagtatcaaaacgtaatcaagggttagcaggacgatttacttataactggaactatcgttactttgttgattttaattttggttataccggatcggaaaattttgcaccaggaaatcaattcggtttcttcccggctttttctcttgcatggaacgttgccgaagagtcatttgttaagaataacttgaagtggatgaatatgtttaaaatacgttattctcatggtaaggtaggtaatgataatattggggataacaaccgtttcccatacttatatactatagccactacaggatataacagcgaaggcaagcctaattatgtatataactggggatttggtgattatggaaaatcattcataggaactcattacacacagatggcttctaatggcattacttgggaagttgcgactaaggatgacctggggattgatctttctttgtttaatgacaaatttacagcgacagttgactatttccacgaaaaacgtacaggtatttttttaacacgtgagttcttgcctgacattacaggtcttgagagcaaacctaaagcgaatgtaggtgaagtgaaatctcaaggtttcgatggcaattttgctcttaagcagaaactgggtgaggtggatatgactattcgtgggaatataacttatagtaagaatgaagtgctcgaaaaggatgaagagaatcaagtctattcttatttatatcaaaaagggtatcgtgtagatcaagttaaaggattgatagctgaaggattgtttgctgattacgatgatattcgtaccagcccgaaacaagagtttggtacagtgcagcctggagatatcaaatataaagatgtaaatggtgatggtgttgtaaacgataatgataaagttgctattggcgctactaccactccaaacttaatatatggtataggggcatctttcgcatggaaaggaattgatgtaaatgttcacttccaaggtgccggtaaatccactttccctatttatggtaagtgtgtatatgcattcagcgaaagtgactggggaaatatctttaaagatatgataagtgatcgttgggtagattcagagactgctgccaaactgggattgcatgctaatgagaaccccaatgcaacatatccgcgtttaacttatggggaaaataaaaacaaccaacaaacctctacttattggatgcgtgatggtcgatatattcgtttgaagaatctggatatcggttatactttgccaaaaagcatagtcaataaactgcacttcaataatattcgtatctatattgcaggatcaaacctgattacatggtctaagttcaaaacatgggacccggaaactggcaatccgcggggtgaagcctatccgctaacaaaatcagttactatgggtttatctgttaacttataaaaatactaagagattatgataaagaagatttatatattattattaaccgtattagggatgggagtaatttcttcttgctctgattacctgaattcggagaaatattttaaggatcgtctgacactggagaaaactttcgaaagtaaggatcatgtggaagaatggttagcttatgctttttcatttataaaaaatgaaaactatgaggtgacgactaaaggaccaagtgagaattcgttttgtttttcagacgatatgtattatggtgaccgcgataagacaatcgatgcaacaaagaatgaattgtcatataatatgttcaagttaggagaatatgatgagaatacttataatgttggggcatggggggcatgttataaaggaattttccaagcatcagtatttatccataatgttgaccggtgtcaagagatggctgattgggaaatactagattataaggggcaggctcgttttgttcgtgcttactattactggttgctcttacgtcgttatggtccagtgcctattatgccggacgaaggagtggattatactcaaagttatgatcaaatagctactccacgtagctcatacgaagaagtggcacaatatatcagtgacgaaatggtacaggctactaaagagttacaatatgatcgtcgtactgataattatgctataggccgacctactcgtggagctgcattggcagttcgtgcttatgcactgatttttgcagctagtccgtttgctaatggaaataatgatgaatatgcgcagcaattggtagatgatgaagggcgtcgtttgctttcttccgaatatagtgaagaaaaatgggcaaaagctgctgccgcttgccgtgatgtcatcgatttagatgtttatgagttgaatattgtaaataaatccacatctgataatggaccttctgaacgtccgactgttactccaccggctgatggcgagttttccaatcaaccctggccaaaaggatggacaaatattgacccgctcagatcatatcgtactatctttgatggtactatattacctgcaaacaataaagaactgatatttacacgcggggcaacaaatatagatatgttggtacttcatcagatgcccaaagatgatggcggctggaactgtcatggtatgacacagaaaatgctggatgcatattatatgaataatggtagtaatgagccgggtatgaactctatgtatcaaggagtagctaattatcaaggtattgtagatactcgtgaacgtagaaccggatttactgatttgcaagacttgaaggataataaatatccggaattaggttggaaatatgatccgaagaaaggagataacgatcaggccaaaactgggatgaatgtttctttgcaatatgtagaacgcgaaccacgattctatgcttctgttgcttataatggctgtacctggtattatttgagccagactgaaagcaaacctgccgatgtaaatcaacaagtttggtactactttggaagttccgatggttatcgtaatgacggtttctacttgcgtacaggtataggaatcaaaaagtttgttcatccaaacgactatccaggcaattatgttgcgaaagctgaaacagcaattcgctatgcggatattctactgctttatgctgaagcattgaatgagttgactggaacatacaatataccttcttggaatgaggcgacaacctacactatcagccgtgataaagaacaaatggaaagaggtattcatccggtacgtattcgtgccgggttgcctgactatccagacgaattttatctgcagagtggggttgatgatatgcgtaaagcattaaaacgtgaacgtatgatagagttaatgggcgaaggaaaacgttactttgacattcgccgttggaaagatgcgccagtagaagaatctctgcaaatatacggttgtaatgtctttgttggtgaagctaagagagacgaattccattcggcaattcctgtttacaatctcccgtctactttctcggaaaagctatggttatggcctatcaaacatagtgagttgaaacgtaattcacgtttaacacagaacccaggatggacaatgtatgattaattctaaacataaagacttatatatgaagaaaatatatactttggcagctttggctgcaatgacaatgttgggaacttcctgcaattcggaatgggaagatgaacaatatgagcactacatttctttcagttcacaactggatagtaagggagtgacgaatatatatgtaccttatagccgccatgatgcagaaggaaattatgcagaaggaggagaagggaggtccaattatcagttaccgatacttgttagtggttctaccgataatccaagtaatgtcactgtacacgtagcacatgatgctgatacattgaatattttgaattacgctcgttacgctacacgtacagaactatattatgaggatatgggagcagaaggattggcatacgcttcatatccagaatctctacagataaaagcaggagaaaataaaggtttactggatcttaaatttgattttcgcaacattgatatgtcagaaaaatgggtacttccattgcagattgtagacgacgcgtcttacaactacgtagctcatccacgtaaagactatgctaaggcgatattgagaatcttcccatttaatgattactctggcgattattctggtacaggaataaccaacaaggtggtgacgggatatgatggagatggtaaaccgatagaaacagcagaatctatcacaaaatcgtcaataagagggtatgtgatagatgaacagactatttttacgtatgcaggaatagtagatgaggattatacagaccgtagaaagtataaaatcaaatttgcttttaatggtgagacgaatggttcggttactatttcctgtgataatgcagaagagattggatttgaattaaacaaggacgtgactccttcatttcgtatttcttcatcaatggatgacgcgaagccttatctggaacaccgttatgtaataattaataatgttgattattatttcaattatataccagtggaaggtaccatcattcgctatcatgtaaaaggtacattgacattatcacgtgatatcaatactcagattccagacgaagatcaagcaattgaatggtagtttctattaatcgctaatctaatgattcaagaagagggtgaagttcaagttattgaattcaccctcttctcttattttgaaaagttattttaggactgattgtgtgccgtttattgtcaaatatcctaaagcatactatttcgtttctgcaactgtagaatacgtcacgctccctagcttcccgtcattactcagtgtctcagcttgaataatcaatggcgtggaatactgattattgtaacattcgatcactgcctttccattttcatccgtctgcacagtcggattccagtaaagagttcgtcttttgtctgctttatccatgtataattctttatctatataagcaggagaataatactccaatgccggtgtatatccctgcataacagtctgccgggtaccaagagccgcagtctcgtgtttattcagaacatcatgtctgggcaatggaatgaggtagaaaatactatatttgtccagttccgatacatctacatcattggaattagacattttggtattctggataatttcatcatctactcctcctgtgcctttactgatgataatagaagccaaaccgtctatttcagtcagcatcatgtttacttctgttgacgatagaattttgttatccataatataacagatcggtttctggcggtaagtacagttatcattggaacggtcccagtaaaagagtggatttaatttttccatcacctccgggatagtggtgacaactttgccattgtcgcgaagctgatcgacagcctggcgtatatcatagtaggcatcaatactttgctcattaattttagtcgccatattcgtactttgactgcgccgcttacttttgatttcaacttcgtccaaaagataaagcccgtctacccgacggatggaatccatatataaagagtcgaatttttcagcttcctgttgccagtgggcaatgttgctccactccgggtgcaactctctgtaaccgtatgcacgcgtagcaggcgagaaatgccggtcgatgagaatagaagcgtccttatttcgttcttttcccactttgcgagtctggatcacagcttccattgatccctcgaaatcttccagcggaatgctgaaatgtccgttctcatccgtaacggtctgaccggtaataatctctgcatctctcttcaccattacgctgagagctatatccttcagcttgtttttgagaatcgtagatttgacttgtccataaagtaccagttggctttctggcaactgaagtggggtgaatgggctgataccgatctgttgtgtcatatcatatttacgccatccgtgtaccattaacagtatatccagttccttctgtttccggagagaactctctgtgaagtagtagccgggttgatgaatgtagcctttcaagtccgatgtaagtagaaggtcggtgaagatattgttatcatattccatataatcagagcggacggcgtcacggatactgactgataatttgccgggtatcggttctcctatggcgttgttcaactgcagttcgcagcggatgggagcataaggagcgtaaatctcttttaaacctttgggcgagatttgtaaaggagcccgtggagaagcaaagataaagcggtcgcataaagtatttccggcacgattgagcagactgatttgtaagactcctgccggtaacttgcgcgacaatactgtaaattgctgaggcttatttgcctgacagtggataagctgataggcatggggacgtccctgatggcttataaaaacggctaatgtatcctgcggggtcgctgcattacatgataccgtcacagaaatagcccctgcattattgcctactttcagaatatacccgcttggcagtgctttagggagggtaaattcatactgttttccttgaaagtttactttagcgattgccggcagagcagaaggcgtatactcaaaagctcccattccatcgtgtaaagtttcaaaagacgtgatttcttgcccttctttggtataaagtgtgcctgataattgaatatttccttcatttttgctttctgctttgaaagcaacctgcgaagttatcccttcgactaactgtcctccttccggaaagaaacgcagactcagcttctctcttgtttcttccggccttttctccatagacggactcaactcataggtgctgatactacgctccaactggtcgctatgagaaagctgatagacagggaaagtacgtgaaaagtactgcggatcactgaatgcaagcatccagcgggtgtaagcacgtacttcgtaataaccggatagcattgactgggggagtacaaactgcccgttgccttctccttatgatagtttaatgatctgtttatcagtaacgtgccctgcctgatctaccagttccacatacaaaggacggctgattgaactgaaaacttgtttttcggcaagagtgacatatgctttgaaccatatcgtgtcgcccacataatagcttgtattatcaaaatgcagatatgctttttcacgcggatagttatcggcaaaagtttgagcttgattcatgtactgttcgaatatcactttagcgggtggattttctccacgtgcagatattgctaaaagtccgcatactgagagtaaaaataataacggtttgtttttcatattagtgctgtctatttttagttgtctattttattgtatgatttttatgttcagcactttctctgtgctattttagtatcatgtgaactactacaaagatagcggtttcgatgaataaagaaggaaaaaaaacgttcaatctaagaaagaaactgttcattactctataaatactaatcggattgctgtttcatgttgataattctttttatcaaaattcgtttgtactgaatgagaaaggctgccttatttttattgttgaatagattttatcattttttgaatagaaaatgttcgtgtttctattgttttttgtcgttctttgtgtatcacattaaacaaaatctaatcaatgataataaatagaattatgagaacacttattattttgcttttatgcacgaacacgagttttgcgatagctcagatttctcccaaagcagttgagaagaataaccaatctgtgaaaactgcgggtttctttaatgattccgattctttaaataaggctattcatctttcagatgaggcgatagctttggagccttcatacaaactggcatatgcaaataagattaaatacttaatggcgttgggacagaaggagaaagcactgcaaaccatgttgcaaatggagaaattctctccggatgatccttactatattttaggtaagggaatgatgctggaagagaatgctaaaaagagcctggctatggatgcttacaaacaagctgcctctcttttcaaaaaacgcttgaaggagaaaccaactgaagcagacctgatgaattatgtattcgtactctttttgagggataacaaaaattattctttggatgaaatcgaaaaggagtatccccaaatcttcagtccagcaataagacaacacacgaaaaagttgatagatgaacttagcaataaaagagaggatgtaattcatgagatgctaggtggtaaatgaaaacatagggattgcgggtggtttacttcattcctattttgttgatggagctattctgaatgattcttgcacgctgtttgttccggatggtgtttctccgtcagaatatcgtcagtctgatgcttatcaacaagcatccaagaatcagcaggagcatggtggctctcttagccttgttgccgattcactacaatatgcgtatatgaaagctcaggttgagtatataatattgccgtttaagaaacggttggatggcttcacatattggcaaagagaattggaaccggccattcatccggccttgaaagcgtatgtcaaagcggaaaatgcgacaggaggagtttcttcggttatgatattttgggaaattgccaggaacacggatcatttttgcagtgattttaaaacagatcgtgatgtgcgaatgttcctgacgctttatttctggaaatatttgtgttattttgcaaatatagatttttataccggtcaggataaaactgaagagattctgaagggggaggctgattagtttggaaatctgattattagtttaaaacaagaaccattaatgttatgaaattgagaattgtacatttgttattattgcagtccgtaatgcttcttctttcctgttccaatcagagccggaagaatatggatacatcggcagaaccagctgacgtacaggcgaatgtgtcggacagtagtagaattgaacaagaagccatcggcatgattgaagacttttatgaggcttatgctgccagtttcatgtccaccggtaaagaagctctcgcacttggggattcaattaagcaaaagtttctgaccaaagagctgatagagaaagttgataggctgatagaggcgacagatgccgatccgatcattcgtgcgcaagatttaggtgaaaatgacatgaaaacattgtcggtgaaacatctgaatgataattggtatgaggttaactatacttcggctaaaggcagccagtatgaacgtgccgtgagtatcccggtcagagtggttaacgttgacggacaatatctgattgatgatataactccggaaaactgatcgtatcattaaatgatatgaaaaaagacaaacagcatcttttacgctaggcaaaagggctgtttgtctatattcaacgaggaaaagagtattcgttttatttctgttctttgactttttccatcagtagcttcatgtagtagccacctactacggaacgtgccttgaaattcatcatctttcctgtattcgtatcatgccagtcgctgataggcacacgggaagttgtttcgttcgcataagtatagatcgggtcgatgaacttttggaacgtagcatcgtctggagacatacaggcactccatagtacccagtcggatttggtatattgtgcgcgggagtccaatagcaaaccatatttattttgcttggtcagatagaaaggaatttccgtatcaaatactttctgcgggaaaatgttcatgttaaacactttgtcccatatcagattgtatttctgactccacgttcccggtttgtcaaatgccagtttgtagtgatcgtcgtcaaatgccatcttctcccattctatcgccagtcttttggcggtttcgatgtatttgttcgcagttgtttctttgcccagcatacgtgccatttctccgtatccggcgattgccatgatcgctttggcggaaagattggcattgtgtgccagatgtccggcaaagtcatctgtacaaagttggttttcagggtccagaccgttctcaatcagatagtttgcccatgttgataatgtttcccagtatttggaagcatagttggcattgccttccatcatagagatggctgtagttaccagaatcatgtttccggcttcttcgataggcatatcttcaccataaagttgcccgttggctattggataagttcctaagtcatgagcggggtaaggcttgttccagcgtccgctttcgctgtagtagaagatagagttgagcattcccttcatcagttccgtattgtaaataaggtatagtggagcggatggataagttaggtctactgtgttgatacagccgttactatggttctctttggataagaaaagcaggttgccttccttgtcggtaaggagtttatgggcggtaatggagtggcggtaagtcaatgcgagtagttcggcatatttcctgcctccggctttttctgcatcagccatcagttgttggtcgaaggcacggcaacgtttcatcaatgagggataagaagcctgcgcacgttcgaaagcatcaaagatgctgacttgaccgttgtgtttccagtatgccatgcggcgttcgtagaaatattcgatcgagtagatatcgtcgtagcctaacatcacatatccgcttttcccttgattgtctaccttgcctaagttttcggtataagccatggcgggcatatcgctttcgctgcgggtgatgaaatcctgggagtttggcaatagtttgccgttggtgatgaaggcttgcttcatgtcatagtagttacctatgcttaagtccttgttgggtgcgctgttgcttcccagataagcatatccccagtcgatgcgtacaccgtctcctttacgttttacgtaaggctggtcgatggtacctgccttgaggtaatccattccgtttttgctgatcttttctgagatggttggttgtgacggttcgtgtacggcaagttgcggggttgtttcgatatacacttgcacatcatgttgtttcttgtcgagtgaacgtacccgataggagatgtagttgataggggtcgagataagatcaagatcttccatcagcagaggtgctgtgaatacgagatccagttctaccggaccgcaggtgaatgtatagtaggtctgtgtcggtaatacatcgacagacttctggatagcagcttccttgaagttgctgagctgtttgttctcacggaacaggccgaaatcaacgtatgctccgccggttgtgttgtgacagtgtgctgcaataatgtttgttcctttacggagcttggctttagctgatgcggatagttcgatggtaacatcgtcattccaggaataatcggttgccaccagtttttctccgttcagatagagctcgaatacatcgtcgtgtgaataacgtaagtagataatgtcgtttgtcaggtcttgattgaggttgaaactacggcgtacccagatgtcttcggtgttccactctgtgccgatgcgtttcatgtctttggtgccgaaagcggctttgcccttggtccatccggaatcatcgaactggggctgtatccagttggccgccggttggctcatggtgaactttgcttcccaacgttcggtgtttgtcatcggaaggattgtttcgaggtttagcttgtccttgcccatgaaacgatatactttcccgtccacccggagcgctcccagtaaaggatgggtggcggctgtccagtgttcggtgttcccttcgttcagttcgttgtagggagaccagatagcaagataagtgtcggaagtgatcagaggtacggacggtgcacgcaaagcgatatcctgactcgttttaaacaggtcagttgcctgcacattgcatgcgaggcaaactgacatgattgtagagaatagtttattcattaatatgaaacttttatttatttagcgagttacaaattttctggttgatggctttgattttaggctcgtctactttaataactttccggtcgtaagtaaccagaccgttcacttcttcttccacatctgtgatttgtgtgtatacggcagccgagaagcctttctcgatcagttccaataaatggtctgcatattttatgtattcattagtcacttcttccggcgtgttgaacttcacgtagccccagttcttgtctgccagccacagatgtcctttcagtgccatacctataccgccatattcgcccagtacggtagcgcgtatcggatcgtagagatagaggttcggtccgggatagttatgaaggtcgagaatatctccgcacgtgtagtggttacctccactggcagggtttaccagacggctggggtcgtattctttcgtccatttagtgatttcaggagtcttgaattgtccccatgcttcgttgaaaggtacccatacgccgatgctcggataagaatacaggtagtcgataatttctttccattctttgcgatagttagcttctgatgctgcggagcggatggcgtctgcgccgtcatagtacttgtgcatctgccattcggcaggaccgcgacctccgttcggcatatcttgccatacgatcagtccgagttggtcgcaataagtataccagcgtgccggttctacttttacgtgcttgcgcaccatgttgtagccgaaatctttgatcttcttcaagtcatataccaatgcttcgtctgttggcgctgtgtataagccgtccggccaccaaccctggtcgagcggaccaaactggaaatagtctttgttgttgagttgcaggcgtgtaataccattcttgtctttatgagttgagaatttgcggagagcggtgtaactcttcacttggtctacagctttgccgtctttataaagagtgacttccatattataaagtgaaggagactcgggtgtccataatttaacgtcttccggcattgttaattctaccggtacgccattgagcgctgctcctttggctacgaggtttttgccgtcgaatactttcacttccactttgtctggagagcatacgttggtggctacttccactttgacagtcttcttgtcgatatccggagttgttttcagttgggcgatatgctgggcagctaccggttccagccatacagtctgccagatacctgtgactggtgtataccagattccttccggtctttctacttgttttcctctcggctgttcgccacggtcagaggggtcccacactttcacaaccaactggttattgcctttattcaatgcggaagtaatatcaaagtagaatggagtgaagcctcctgtatgttgtcctacttttacgtcatttacccatacatcggctttccagtccacagctccgaagtgcagtaatatttgtttgcctttccatgctgacggtacatcaaaagtacgctgataccataattcctgatgctcgttaatggttttacctactcctgacagggaagattcgactgcaaaaggtactaaaatctctccttggtaattgtttggtgccggttctccttttttagtaatcgcataattccagctaccattcagattcttccaatcctggcgttccataatggggcgtgggtattccggtaatacgtttttaggattcaactgctcaccccacggagtctttatcttatcaccggcgggcttccattgagcgaatgtcgggctacaaagagccaatgcgaatagcactgctagaaaattctttttcatggtaattatctttatatgtattaaatagaagaattaatattcataaaaggaatattgcaaagaaaagctaatcagagaagaataaaggaaatttgctgttcaataaatgataaatgctcgtcattttatagtgaatgacagttttttatgcgataatggttattttttgtccttaattgaataataagtagcttatattaccggagataattatgacttttggagggagaacaatcgtatgtttccgcggatagtcgtaaataaactgaaaaacaactataataaactttatcaatgagaattctttttttattagtagtattgtcggttacttctgccctacagtcgcaggtagtcattaaagagaatgctattcagagtaagtatgcttttcccttggttacttcgaaagcgaaagctgtagtagtttatgatactgatgactatttggtggtacgtaagactgcggagctttttgtttcggacgtcgaatcagtgaccggacaacaattacggttgacggacaaactgaaaggcgacaaagagattattattgtgggtacagttgagaaaaatcggctgatccgccagttagctgagaagggcaagctagatatctcttctttggaagggacatgggaacgatttctgattcagacggtttcccgtccattccccggagtcagcaaagcgctggtagtagcggggagcgacaggcggggagctgcgtacggacttttttcgctttcggaaatgatgggagtgtctccttggtactggtgggctgatgttccggtgaagaaatataagacgctttatgtcgatgcccccgccactttgtccaagactccttcggtgaagtacagaggaattttcttaaatgacgaagactggggactgaaaccttgggctgccaagacattcgagaaagaaagaggaaatatcggtcctcgtacctatgccaaaatatgcgagctgttgctgcgactgaaagctaatcatctggcaccggccatgcaccccgtttctaccgcattttataagataccggaaaataaactggtagctgatacctttgccattgttatggggtccagtcactgcgaaccgttattgctgaacactgccagcgaatgggacagcaagacgatgggaccatgggattataacaagaacaaagataagatcaacgaggtattgagtaatcgtgtgaaggaaaactgtgcgtatgaaaatgtatatacgctggctttaagaggcttgcatgatgcagctatgggtggcggagatgtgccgatgcgggaaaaggttaagatgctggaaagtgcactgaatgctcagagagagatcattgcccggcatatcgacaaacctgttgaaacaatcccacaggcatttacgccttataaggaagtgctggaaatctattcgaacggactggaattgccggatgatgttacaattatctgggcggatgataatttcggttatatgaaacgtctgagtggtccgcaggagcaaaagcgctccggacgtgcaggcgtttactatcatatatcttatttgggtgttcctcatagctatttgtggtatagtactacccctccggcattgatgtatgaagaacttcgtaaggcgtatgataccactgccgatcgtgtctggctggcgaattgcggagacttgaaaggggctgaaacacaaatctcccttttccttgatatggcttatgatatagacagcttcaatgcggataatgtcgccacttatccggcacgttggctggcaaagatgtttggtgaggagtactacgatacattggaagatataacttgttctcatataaatttggctttttccagaaagccggagtacatgggctggggatattggaataactattggggaggcggagagaaacgtacggatacggagttctcttttgctaactataatgaagcggaaagacgcttgactgagtatagccgtattgggaaaaaaacggaggatttgttagcttcattggacgaaaagagtaaaccggctttctatcaattattatactatccggtgaaaggggccgaactgatgaatcatatgaccatcaaaggacagttttaccgtcagtatgtccgtcagcaacgtgctgccgccaatcggcttaaggctcaggtgaagtgctatcatgatagtctcgaaatcataaccgatggatacaactctctgctggatggaaaatggaagcacatgatgtctttaaaacagaactatgatggtacgagttcctatttcatgatcccattgatggaagaggaatacacacctgttggctttcctaagctggggcttcaggcagaaagcgaaaatttggataaaggaggaatgagttttcatacattgcccgcctacagcacttattcacgtaaaagtcattggatagatatatataatcaggggaccggagagctaagctggagtatcacgccttcggaagactggatactgatctctcagaaaagtggtaagacgtctgcggaaaaccgtatctatatatctgttgactgggataaggtgccggcaggagaaaaggtgaaaggacaaattgatataacttccggcacccagaaggagactgtactggtttctgtattcaatcctgagtctcctgcacgcacagaagtacaaggattgtatgtagaggagaatggttacatttctattccggcagccgatttccaccggaagtttgagagtaatgacattcggatgagtatccttccgggacttggttttgaggggcgctctttgcagttggggaatccgacagctcccttacaaatgtatcgtgcaggtgatgtccccagggtggaatatgatttctatacatttaatgccgggatttatgatgtatatacgtatgttttgccgacatttcccttgcatgctgagcgggactacaaattgccggaacatactaactcggatacaaagtatagtgtccgtatagatgatggttccatttctactccttctacttcagctatcgaatattctcaaatctggtatgatagcgtattgaagaattgcagagtgaataagtctactttgtatgtaaagaagcccggtaagcacactttgcagatacgctgtggtgatccgggcgtcgttattcaaaagattgtcattgacttgggaggaatgaagcgttcttatctcggccctcagagtacaatctgtaattagttctgttttttatgaataggggaaccggatggccttgccattggttcctcttctttttgaggggttcccagcacgggcattccgtctttgtcccagtctatcttctgtaaacggggagaacgggaatcggatgcgccaggagcgtcattcggtatctggcgggcatgatatagcatataccattctttcccatccggagacggagtgaaagatattccgccgggaccgtatacattgttttcagggtcttgttgtagtaccggaaccggagacttcttccaggaagccggattgagtaagttagcttttgcgtctgcagtcagtaatccgacacaataataaggagtccagctaccactggctgaatagaagatgcatgctttgtctttattctttgattcaaaatattggggtgcttcgtttacatgtatcggataggctgttttgctgccatccggatttacccattggcattcccattcatattcaggtttggagatgagaatcctgtcagaagacagtgtccatggattcttcatagtagcgatgtagatacattgggtttcactgtctatccttcgtttttgccagccgcaccatatcatatagcgttggccatcatgttcaaaggtgctggcatggattgcccagttgttgtctttatctgtctgtatgcgtcctttcatcacaaatgttccttccatggggttggcggcttcattctcgacaacataaatctggtgattatccatattgccgtcgtctgcggcaaagtaaatataccatttgttatttatacgatgaatttcgggtgcccacagatgataggagttgctggggtcggtgggtatccatacatctttttgagtagcatgtgagaggtctgttatatcatcggtttcccaaagtatgactctgttttctgagccctgtgtataataatatttgccttcatgaaaaatagcccatggctctgctccacgttcaagtaacgggttcgtataggtatttcctgcggctacagtttctttctctgttgtagccttcttatgctggcaagagacaccgattaataagataatggataataaaaacaatctgcttctcatggtacttctcatttgataatgacaatgcaaagtaagcataaaatattgataaatcatgcaaatggaagtagaatggtcagtttttgttgttaaatgaactgtaatttctgaaacttttctttgttttttctcatctttgcgaagtgaacttttaaataaataatatatgaaacttagacatctttttcttttctgtgtaatttgctgttctgtatctatatctgcccaaaacaaaagtaagcttccgaaaacgagtggtaatcctattttccctggttggtatgccgatccggaagggattgtgtttggagacgaatactggatttatcctacctattctgccgcttatgatgatcagatattcatggatgctttctcatcaaaagatttggtaaactggaccaagcatccgaaagtactttccaaagaaaatatcagctggctcagacgtgcattgtgggccccggcagtaatccatgctaatgataaatattatttcttcttcggagccaatgatatccaaaataataatgagttaggcggaattggagttgctgtagcagacaatcctgcaggaccttttaaagatgcgttgggaaaaccgttgattgataagattgtaaatggtgctcagccgattgatcagtttgtatttaaggatgatgatggacaatattatatgtattatggtggttggggacattgtaatatggtgaagatggcaccggatttattgagtattgtaccttttgaggatggtactatctataaggaagtgactccccaaaattatgtggaagggccgtttatgctgaaacataatggaaaatattattttatgtggtcggaaggtggctggggaggtccggattatagtgtagcctatgccattgcggattcaccgttcggtccgtttgaaagagtcggaaaaattctgcagcaagatactaatatagcaaccggtgctggtcatcattcggtagttaaaggtcccggatcagatgaatggtatatcatttatcaccgtcgtccgttgggcgaaactgcagcgaacagccgtgcaacttgtatagaccgtatgtattttaataaagacggaaaaatagagcctgtccgtatgacttttgaaggagtaggagctagccctttggcaacccctgttcgcgctaaaacatatgctaatcctgtaataaactttagtttgcccgatcctactattataaaaggagacgatgaatattactatctatacgcaactgaaagtattaaaaatgtacctattcatcgatcaagagacttggtaaactggtattatgtaggtactgcttttacagatgctacccgtccaaacttcgaacctaaagggagaatatgggcaccggatattaataaaatcggtgataaatacgtaatgtattattctatgtccacttggggaggtgagtggacatgtggtattggtattgctactgctgataagccggaaggaccatttactgatttgggtaagttattccggagcaatgaaatcaatatacagaattgcattgatcctttttatattgaagataatggaaagaaataccttttttgggggagcttccacggaatatatggtacggaactgacagatgatggtctctctttgaagaaaggtgctccaatagagcaaatagccggtactgcttatgaaggtacgtatattcataaacgggatggttattattatttgtttgcttccatcggccgctgctgtgaaggtttgaagagcacatatactacagttgtggggcgttcgaagaatctgttcggcccttatgttgacaagaaagggcgttcaatgtcagataatcatcatgagatattgattcagaagaataaggcatttgtcggtccggggcataattctgaactggtgacagataagaaaggaaacgattggatgttctatcatgcggtcagtgttgctaatccggagggccgtgtattgatgatggatcgtgtgcagtggaaaggtggctggccgtttgtgaaaggcgctgtaccttccttggagactgctgctccggacttcagataagttttttcatatggctattcatttctttacaatgaaaaatgagcatataaaatgtagttgaagtttaaacaaataaattttatccagacactttatccagaatagaaaaagtattggggaaattgcaaagagaaaactatttatctataggaaatgatggcttttctctttgcaattaactttttctataaaggtgggcttttttttgatttattgttttatttttgtccttgtaaactcataaacttgttatagatggcctcagatatacacactctctctgattctcttttatggaagaggtttctcgaaggagattcgagtgcgtattctcaaatatataatcagactgtacaagagctgttccgatatggtttactgtatacttcggacagggagttggtcaaagattgtattcatgatgtgtttgtgaagatttacaccaaccgtgccaaattaacccctactgataacattatagcttatttgatggtggcactgaaaaatacactctttaatgcgttaaagaaaacatctgattctttttcattggacgaagctgatgagaaagaagaccagtccgaagagcatttttctactccggaaactatttatataaataaggaacaagagaagaatactcatatgaaggtgcatgctatgatgtcctccttaaccaccaggcaacgtgaaattgtttattatcggtatattaaggatatgagtattgatgaaattagtaaaatcacggacatgaattatcagtctgtatctaactctatccagcgggctttggggcgtgtacggaatctattcaagcgagaataggagagaagaatattcagctttttcctgcccatcaaaaaaatatcgaaaatagtttgagaaaagtgagtataaaatcaaagtagaactgttatcctaatgtaaagacaataaaaatgattaattcagaactgaaacatactgatttttctagatatacttttgaagaattccttcaaaatgatttttttatttcttctgttaaatatccaacagaagagatacaagagttttgggatcgttttgagaaatctactccttctaatatagatgattattttgcggcaagagaatatatagaaacgatttctacttcagaaggtgatttgctttcggatcaggaactgggagagttgtgggctgatatccagacaacaaatattaaaaatgataagattaaacataaaaacttttttctgatagggttgactgccgcagccagtgtagctattttggttggtagtttctttttattaaagaattatcaggcggttttggctcctgatattgcgacatttgcagttcagactaagaccgaattaccggctacagaggaaacattgttgattctggcagaagataaagtcgtaagtctgaaagaaaaagagactacaattacctatgattctgtagcaattaaagctaacgaagaaaatatatccaaaaaagaactggcggtttataatcagttggttatcccacgtggaaagcgttctgtactgacattttctgatggctctaaagtatgggtgaatgcaggtaccagagtcatttatcctacagaatttgaaaaggataaacgcgaaatctatgttgacggagaaatctatattgaagtagctagagatgaagaacgtcctttttatgtacgtactaaagatatgaacgttagggtgctgggtactaaattcaatgtgacagcttatgaatctgagccaattcgcagtgtggtgctggctcaagggtgtgtgcaggttgagacgacgcaaaccccaaaagctattttagctcctaaccagatgttcagttctgtagaagggaaggaaaatatttcacaggtagatgtggaacaaatgatttcatgggtaaatggtctctattgtttcaatagtgccgatttgggaattgtattgaaacgtctgtccacttactatggaataaatgtcgaatttgactcagcgctaagtaagataaaatgttccggaaaaattgatttgaaagacaactttgagacagtaattaatggattaacctttgtagcaccaatatcttatgcctatgatggacagtataaaacttatcgggtcgtgaaaaaatagacacagaaaaatatagtaattaataaaataaatctcaagaatttatggcgatttttataaagagtggataatactgctgtattatccagatggggctcatatgcctgtaagtattaagttataaaataataatattatgagaaatttggacattgttaatatgaaaaattcaattaagggaagaaagagcaaaatactcaagctatttctttgcttcttacttttgggagtaagttattctttcgctaataacaataattattcccagctcaaaactctctcggtgaacgtgaacaataagacgttgagagaagtctttcaaacaatagagaaaaccagccagtttgtctttttctatttggatgatgcaataaatctggatcgtaaggtatccattgatagcaaagacaagaagatagacgaaatccttactgaactctttgaaggtacgtcctgtacttatagaatctctgacagacaagtttttatctcaggaaagtcagctgccgtttctgccgcgcaacaacagaatgctcgaaaaatcacaggtcgtgtaacggacaccaaaggagagccacttattggtgtgaatgttactgtggatggagataccaatggttcaataaccaatatggatgggttatttgaattgcgtgtcagcaagaagaatgctgttcttaagtttacttatatcggatttaaaccttcggaggtaagaataaactcatctacaaatatctatgatgttgtactggaagaacaggtaaacgaactggaagaaactgtgattgtcggttacggtacacaacgtaaaatcagtaatatcggtgcacaatccagtatgaagctggaagatataaaaactccttcggctagtttgactaccaccttggccggtcgtctggctggtgtagttgctgtacaacgtacaggtgagcctggaaaagatgcagcagatatctggattcgtggtattgctactcccaatacggctactcccttgattttggtggacggagtagaacgtgcattcaacgatattgatcctgaagatatcgaatcattgactactttgaaagatgcatcagcaactgctgtttatggtgtacgtggtgcgaatggtgtaatcataatcaaaacaaagccgggtaaaataggtaaaccgacaattagtgctgattattatgaatcatttacccgtttcactaaaatggtggatttgacagatggtgtctcttatatgaaggcggctaatgaagcgttaagaaatgatggactggcaactaaatttacagattcacaaatccagaatacaatcttaggtaaagaccagtatctgtatccgaatgtggactggctgaatgagatatttaatgattggggacacaatcgtcgtgttaacgtgaatgtacgtggtggtagtgagaaagtttcatactacgcttcggtcagctacttcaatgagactggtatgacagtgacagataagagcatcaatacctttgattcaaagatgaagtatagccgctataactttactaccaatctgagtatcgatgtgactccgacaactaaagtggaaattggtgctcagggttatctgggtgaaggtaattatccggccatatcttccaaagacttgtataatgctgctatgtccatttctccggtagaatatccgaaaatgttctttattaacggtgaggcatatattccggggcgttccaccaataacaacttcaacaacccttattcacaagctacacgtcgtggatatgataatctgaccaagaatcagatttattctaatttacgcattacgcaagacctggatatgcttactaagggattgaaattgacagctatgtacgcattcgatgtatataatgaaatacatgttcatcaggatcgtgcagagtctacttattatttcttggatacgaatgttccttatgacttggacggacagccgattctgcaaagaatctatacgggcaccaatgtcttgagttataagcaggaaacgagtggtaataagaaaacatatctggaagcttctttaaattacgaccgcgcatttggcgatcatcgtgtaagcggattattcctctttaatcagcaacagaaacttctttatcccaaaggaacactggaagatgccatcccttatcgtatgatgggtattgccggacgtgctacttattcatggaaagaccgctattttgcagagttcaatattggttataatggtgcggagaacttctctcctaaaaatcgttatggtactttccctgcgtatggtgttggttgggtgatttcaaatgaaaagttttgggaaccgctgtcaaaggtcgtatcattcctgaagatccgctatacggacggtaaagtcggtaatagtgatgtttccgaccgtcgtttcatgtatttgaatcagatgaaagaaaatggagactatggttataaactgggacctaacgggacgaaatattcaggatatgaaacattgaatatggctgtggacttgatttgggaagaagcacgcaaacaagacttaggtattgacttgaaactgtttaatgatgatctttcaataatcttcgatatcttcaaagagcgccgtgaaaatatcttgttaaaacgtgaaaactctattccgtcattcttaggatataatacatctgctccttatggaaatattggtattgttgaaaataaaggtttcgatgctacagtagaatacaataaaagatttaataaagactggacgcttgctattcgcggtaatattacctataataaggataaatggattgaaggtgaattaccggaacaacgctatgattggatgaatcaatatggacagaatattctaggaaaaaaaggatatatcgcagaaggtttgtttacacaggctgaaattgatgatatggcacgttgggagtctttgtcccaggcaaataaagctactactccgaagccgtttgcttctcagtttggtacggtaaaagcgggtgatatcaagtataaagaccttaataatgatggtcagattgacgcttatgataaaacttatatctgccgtggtgatgtacctactatggtatacggttttggcttcacgctgggttggaagaacctttcattaggtatgatgtttcagggtactcatgatgcagaacgtataatgagcggtagcagtattcaaccgtttaacggcggtggcggttccggtaatctgtatagcaatattgatgaccgctggactgaagataacccgaatcagaatgctttttacccgcgtttgtcctatggagctgaaacttccagtaatattaacaatttccagccgagtacatggtgggttcgtgattttagtttcctgcgcttaaaaacaatgcagatctcctataacttaccgaaagactgggtgaataaagtacgtttgaaaaatgcggcagtctatgtgatgggaacaaacttgtttactcttagcaaattcaaattatgggatccggagttgaatacagataacggtgcttcttatccgaatacaacctcttattctgtaggcgttaatttcacattctaaaaaccaataacaatgaaaaaatataactatatactattgggtatgttatcactcttttttgtgacaacacttacttcctgttcagattattttgatcaagtgcccgatgaccgattatctttggaagaaatttttaagaccagagatggagcattgaaatatctttcgaatgtttataccttcttgccggatgagtttaatcagcgccaggtacatgaaaccagcttgtatcgtacaccgggaccatggaccggagcgagtgatgaaaccgaatggacttcatcaggcaataaagccaaactgatcaataataactctattgatgcaaccgaaaacacaatggtattgtatcgttggaaaagctggtattcgggtattcatgaatctgctgtatttaccaaatatgtagatcaggctccgcttacggcatcggaaagagcacaatggaaagctgaagctaaagctctgcgtgctatttattacttctatctggttcgtacatatggtcctgtgcctgttttggaagacgattatgctttggatactcccagtaatgaattgcaattgtctcgtagcactgtagacagatgttttgattttattgtgtccgaattgaaagaagcacagaatgctggtctgctggaagatgcttcgtcagataaaacaacaggtgtgggacgtatagacaaggctatagcccaggcatttataattgaagcattgacttatcgtgccagctggttgtttaatggagagtgcacttattatgccgatatggcaaatccggatgggacgagattattccccagtcaaccggatgcagccactatcaaggctgactggcagaaggtagttactgaatgtcaaaaattcttcgctgattatggcaatcgtttccaattgatgtatacagataaatcaggaaaatcggtagcaggccctgatgctgagggattcaatccttatgagtcttatcgccgtgctatcagaacgttattctcagaaatgggtaataacaaagaaatgattttttatcgtatggataatgcggcaggtactatgcagtatgatcgtatgcccaataagtcaggtaatacaaatgattacagaggtggcagtttgttgggagctacacaagagatggttgatgcctattttatggccaatggtatgtcacctgttacaggctatgcagctgatggtgtcactccgattatcaatgaggcttcgggctataaagaggacggcacttcttcatcagactataaatcggcagatggtactctttatgcaccggctggaacacgcaatatgtatgttaaccgcgaaccgcgtttctatgctgatatcactttcagtaattctaaatggttctcaggtacagaaggcgattatacagttgacttcacttatagtggaaactgtggtaaggctcagggtaacaatgactttaccagtacaggctatctggtacgtaagaatatggattcgggtgaccgtaatcaaaacttggtttgtgtgttgctccgcttgacgaatatttactttgattatatcgaagcattagcatatgtagatccaagtcatgcagatatttggaaatacatgaatctgatccgtgaacgtgcaggtattccgggatatggtactgccagtttgccgaaagcaaccactaccagtgaaatcatgaaactgatccagaaagagaagcgcattgagttaagctttgagaactgtcgctattttgatgtgcgtcgttggggactgacgaatgagttctttaacaaaccagtgcatggtatgaacgtgaactatgatggaaatgagttctacaaacgtacagaaatcacttcccgtaattttgatcgtcaatacttcttcccgattccgcagagtgaaattgatattgataaaaatctggttcaaaatgaaggcttttaattaattgattaataaatcgcaatatatgatgaaacaatatatattttctgcattatgcttagtctcaggtgcgttttgtttgtcgtcttgtaatgatgataaagaagctagaccttatactccggattacgagattgtgcctgaatatacaaacgcagatacatggaaagcttatgaggcatttaatgaacatctgttagatcagaataagtttatatataaaagtagcactgctgacaaggcagctgtagaccgttggaatggtgctgccgcaatttggtgtcagccgacttactgggatatggcaatgaatgcttataagcgtgcaaaggctgagggtgatactcagaaagaacaaaaatttaaacagctttgtgatgatctgtttgccggcaataaagctcattatgcgaattttgattttgatgataataacgagaataccggctggtttatttatgatgacattatgtggtggacagttacattggcacgtgcctatgagctattcggagttgaggaatatctgagcctttctgaagaaagctttggccgtgtatggtatggctcagagaaggtaggtgataccggttcttatgcagaccctgaaaaagggctgggaggtggtatgttctggcaatggcaacctatcaagaatccgaatcctaacgaagctgaccacggtaagatggcctgtatcaactttccgactgtggtggcagctctgacattatacaacaacgtaccgaccggaaggacagaatcgacagactcccatccgagctatcaaacgaaggaacagtatttggctaaaggtaaagaaatttatgcctgggcagtggagaaccttgttgatgttactaccggacaggtagcggacagcagacatggtaatggtaatcctgcatggaaagatcatgtatacaatcaggcttcatatattggcgcttcggtgctgctttataaagcgactggtgaaaaacagtatctggataatgcagtaatggctgcggattatacgatgaatacgatttcgggaacattcgacctcttgccttttgagacaggtgctgagcaaggtatttatactgcggtctttgcacaatatatcgcaatgctggtatatgattgtgatcagacgcaatatataccttttgtgaaacgcaacattaattacggctgggctaacagagacaaaacgcgtgatatatgcggaggcgactataccaagctacaggtagaaggtgatgctgttgaaagttattcggcctcgggtatccctgctctgatgttattgtttccaaccgataaataagtataacctataaatgaaaagaataatgaatacaaaatattctattaagaaagtatggtactatctgctttgtatgataatgactcttcagctaatagcttgtacggaagagactcacgagtcatatactgcagcaccggaggtcgaagatatctatattgaccagctggaagaactgattaataagatgaaggatttgcagaagaactcggaatatggagaaaagaaagggcaatatcctacagagagtcgtgccatcctgacagatgctatcgatgatgccaatcgttcagttctgttgatcaaatatcagaatcctgttccgtcggagcaggaaaagcagcgttacgttgccagtgcaaaatctgcaattgataagtttaagggtactattcgtacggaagatgctgaaacaacacctgcagaactgtttgttgatggtaaaggcggcaattcatatattgatttcggacgtagtgaagaatatgttaagtttggagaacaaggtcatcaatcatttaccgtagagttgtgggtaaaggttacggagcgcggcagatgggataattgcctgttcctgtgctcatacatgtcagacagtagctggcgtaatggctggatgatgtactggcgtaaagatgataatggtgtttaccgtactacttggggtggattgaatacgaccaatggtgacagggatctttgggaaccgaaattccagatttctgatgatttgaataaatggcagcattttgtagcagtatatagtgatgaaggtttggacggcaattctacattacgtgcaaaattatacttaaatggtgagttgaagaaagaagaaacagtttctcctacaacgagagtttatcagtcaggacattattcagattactcaaaaccgatgactgcatttggtcgttacatgagagtgagcgatgatttgtatgaagaaggattctccggatatatgaagaaaatccgtatctggaaaacggcaaaaggggcagattatgtaaagcagtcttatgaaggaacagcagaagtaaccggaaaagaaacggatttggcagccggatgggactttacatctaaaccatcgggaacagataacgagattattgacttgactggtcgtcatacagcgaaaattataggtacctataagtgggaacgtattctagaataataaagagagaaataatgaaagacatgaaacaattaattaataaatggggagagagtatgctcttttcccttctgatggcgctttgcctcacatggacttttacagcttgttcggatgataaagataatgaatatatatctgatacgcaacttagcatattagaggacaatcggacttctttatcatatttgttgaaaaactctacctttggaacagcgccgggaacttttccggaagccagcaaggagatactgaataatgcaatagcggaactggaccagttgattaccaaggtaaagggcggtgagatgtttgatgaggcgacctttgaggctacaatagctaaggtaaatcaggcaatagatgagttcaaaaactctaaatactataacctttctccggaagcccagaagttcattagtgatctgatggcaaaagcagatgagttaagagaaatgatagctaatgaagcattgtggggaaatcatcagggacaatatccggtagaaggtaaggctacactggaaagtgcagcggaagatttggagagtttggcagacagaatcaaaaccagtgccatcacagatatgacgcaggagatatatgatgatgccattgcggctgctgataagaaactgcaagaagtggaaaattccgcatggccggaagataatcttgtctggaatttatttgtggatggtaataagggtggttacatcgactttggatatagcgaggattttgtgaaatttggtgatgataataatcagaattttacgattgagctttggataaatatcaaagaattctgttctaagtcaggggaagacaatagtaccttccttgctgcatttgttaattctccccgaagcggctggcgtgttcagtatcgtaaagtgaatggtggcaatgaacactggctgagaggttctatggcacattggcagaatgaaggtccaaaagatccggaatggtgggagccgagagccatcgtaaacaatcccaaagataaatggacacactttgcttttgctgtagcggataatggtgttccgggatttgatccacctcaggaacatactaaatcctgtgtatttgtgaatggttcgcaatccggcgaggtgattcgtgtaggtgaggcttggagaacttatattaacaatggttgtattgaagagaaaatgcctatgactgccttctgccgtttgaatacagataaaacgactcgtgaagaatacttctccggttatatcaaatatatgcgtatatggaaaggtatcagaagtcgcgatgatcttcgcttatctgctatggggcaggttgacgtagatccgaatgatccgaatctggttgcagcctgggactttgaagtcttgggagcacaacctaccggaacgacaatcactgatattacaggacgtcatgtcgctactctaaaaggtccggaaggaacatatcaatgggtggaaagtacgactatcgcacagtgattaatgcagatttttcaatagtgtattaaattatatcagtgcttccctttgctttgcataatgcagggcaaggggatttttttaagtcattatctgcgtttgcaaatagcaaaagggtgttttggtctgtatttgttctttattgaatagagattatcgttctttttcgtctatttctgcaatctttgtaacaggaaaaatattaaaacttatcaactatcatgaaaagcaaaattcttttggcggtagctttactgctggcgatatcaactactagtgtatgggcggctgatagctcagaaaaaacgaaccagaagacagggtcttacaccaatgaagacgtgtgggcggcatacgaaggatttaataatacgctgctcgacccggataaatatatctataaaacgacttcggcctatgaacaggcggtagaccgtggtcatggcgcagctgctatctggtgtcagcctatttactgggatatgtcaatgaacgcctataaactggcgaaggctcagaaagataaaaagaaaagagcctattacaaagagctctgcgaaaagatattcgctggaaataaagcccaatattgtcactttgatttcgataataataatgaaaataccggatggtttatctatgatgatatcatgtggtggacgatctctttggcacgtgcatacgaactgtttggtgtggatgaatatctgaaactgtctgaagagagcttcagccgtgtatggtacggttctaaaaaagtaggcgatacaggatcatatgacaaagagaacggagggatgttctggcaatggcagccgatccataatcccaagccgaacagaccgggtgacggaaagatggcttgtatcaatttccctaccgtggtagcagcacttacactatacaataatgttccgaagaagagaaaagaatcaaccgaagaatcacccaagtatcagacaagagaacagtatttggctaaaggcaaagagatttatgaatggggagtagaaaacctgttggacaagaagacgggacggatagctgatagtcgtcatggcaacggtaatccagcctggaaagcgcatgtatataatcaagctacctttatcggtgcatccgtattgctctacaaggcgactaaagaaaaacgctacctggataatgcaatccttgcagcagactatacagtcaatgaaatgtctgcgaagcataacctgctgccctttgaaagaggaatcgagcaaggtatctatacggctatttttgcagaatacatagctatgctggtatacgactgcggacaaacacaatatatcccgttcctgaaacgtaatatcgaatccggttgggcaaacagggataagacacgtaatgtatgtggtggagaatatgagaaagcattaccggccggtgctgagatagacagctactcggcttccggtataccggcattgatgcttctgtttccggcagaaaaataatccgaagagaaacgggggtaacgaccagatatagaaatgaaaatacacctgaatatcatgaacaataaacatttgctgattgctctcggcttgcttcttgcctgcaatcatgttacttatgcgcaaaaaggaaaaagcaaagaagcaaagaccacgtttcagactgctgaaccctggaaacccgaaacagacgtacgtgctgatgccacgatggtatatggtacactggataagcccggagtaacttttgaacaacgcattcagtcatggagagacaaaggttatctgacggaatttatgaccggagttgcctggggagactacaaggactactttctggggaagtgggatggagtagacgggcatctgaaagaaggacagcgcgaccgtaatggaaatgaaatagctcatggtcatctgatcccttatatcgtacctaccgaaagttttatccgctatatgcaggaaacacagatcaaacgggtgattgacgccgggataacatccatatatctggaagaaccggagttttggatgcgtggcggatatagcgaagcttttaaatccgaatggcagaaatattataatttcccctggagagctcagcacgaatctcccgaaaacacatacctttccaacaaactgaaatatcatctgtactataatgcgctggataagatattcacttatgccaaagaatacggaaaatcgaaaggactggatatcaaatgttatgtgccgacgcattctttgattaattatacttcctggcagattgtaagtccggaagccagcctggcttcattggattgtgtagacggctacattgcccaggtatggacagggactgcccgcgaaccgaatttctataacggcgtgcagaaagaacgtgtattcgagaatgcgtttctggaatacgggtgtatgaagtcgatgactgcaccgctgaaccggaaaatgtatttcctgacagacccgatcgaagaccgtgcgaaagactggctggactataaaatcaattatcaggccacttttgcagcacagttgatgtatcctatggtagatacctacgaagtaatgccctggccggaccgtatctatcagggactgtaccggatagcgggaacggatcagaaagaacgcattccccgctcttattccacccagatgcagacaatggttaatacactgaatgatatccgtacttccgataaaaagattacaggtacacagggcatcggtgtactgatggcaaactcactgatgtttcaacgttttccgaatcataacggttacgatgatccgcaattttccagtttctacggacaaactttgcctctgttgaagcgtggtattccggtagagctggtacacatggaaaatacccctttcaaagaaactttcaaaggactccacatacttgtcatgtcttattcaaacatgaaaccgatgaaactggaatatcacaactatttggctgattgggtgaagaagggcggaatacttatctattgtggagaagatatcgacccttatcaaacggtactggaatggtggaatacagatggaaatgaatataaagcgccttcggaacacctgttcgagaagatgaatctatcccgtaatccgggtgaaggaacttaccgctatggtaaaggaacggtgattgtgatgcgtgaagaccccaaacattttgttttgaaagccggaaacgatcagaaatattttgaaacgatcgcatccgcttatcagaaaaagcaagggatagagatagaaaccaagaacagcttcattgtagaacgtggtccatataccattgctgctgtcatggacgaaagcgtttccaaagagccactgacgttatccggattatatatcgacctgttcgacaaagacctgccggtactgacttccaaacaaatccaaccgggtgaacaggggtatctttatgatctgaataaagtatccaataaaataaaagcaaaagtactctgtggagcttctcgtatctatgatgagaaagtcagtaaacaaagttactcttttgtagccaaaagcccgataaatacaacgaatgtatcaagagtcctcttgcctcgcaaaccagagaaaatacgtgtgaatggaaaagaggaacaaccggaatgggatgaatcatcaaaaactcttctgttgagtttcgagaacgatcctgccggtgtgaatgtgtcaatagaatggtaaatagattaaataaaacaggtaattaaattatgaaacaacaactgatgacgctgttgctgggagcagcctctgtattttgtagctgtgagacccagatggaacagcatgtgaagagcgagttgcgtgctccggcttatccgctggtgagcatagacccgtataccagtgcatggtctttcacggacaacttatacgacggttcggtcaaacattggagcggtaaagatttccctttaatcggtgtagctaaagtcgacggacagacttaccgctttatgggaacggaggaactggaattgagacctctggtgaaaacttcggaacaaggtaactggacaggaaaatatacgattcagcaacctgccgacggatggcagaatgtcggcttcaatgacgctgcctggaaagaaggtgaaggtgccttcggaaccatggagaacgaacatgtagccaagacccagtggggtgaggaatttatctgggtacgccgtgtcgctgatattcaggaagacttgactggtaagaatgtgtatctggaatattctcatgatgatgatgtgattatctatatcaacggaataaaggttgtagacacaggaaacgcttgtaaaaagcacgtacaggtgaagttatcggaagaagtggtagcgtccctgaaaaagggagaaaacctgattgccgcttattgtcacaaccgcggagcgaatggcttgctggattttggtttgctggtagaattggataataaccgttacttcaatcagactgcacagcagacttctgccgatgtacaacctatgcagacttattataacttcacttgcggtccggtagacttgaatttgacatttacggcacccctatttatggataacctggacttgatgacacgtcctgtcaactatatttcttatgaagtcatttctaacgacggacaggcgcaccaagttgaactctattttgaagctgctcctcaatgggcactcgatctgcctcatcaggaatccgtagccgacagctttactgacggtgatctgttgttcctgcgcaccggcagccgtaatcaggacatcctgaaaaagaaaggtgacgatgtacgtattgactggggacacttctacctggctgctgaaaaagagaacagcacttatgctatcggtgacggaaagaaactccgccaaagttttacagagaataagctggaagctcctaccaccaatggttatgacaaactcgctttagtgcgctcactgggtgaaacaaagaaagcgaacggacacctgctgatcggttacgatgatatttactctatccagtactttggtgaaaacctccgtccttactggaatcgtacaggcagtgaaacaatcgtatcacaattccagaaagcagaacaggaatataagaatcaaatgaaaaattgtgcagctttcgataagaaactgatggcggaggccgaagcggccggcggacgcaagtatgccgaactctgcgctctggcttatcgtcaggcattagctgcccataaactggtacaagctccgaatggtgacctggtattcctttccaaagaaaatttcagtaatggttccatcggaacagtcgatctgacttatccgggagctccgttgcttctgctttacaatccggaactggtgaaagctaccatgaaccatatcttctattatagtgaaagcggaaaatggaccaaaccgtttgctgctcacgatgtaggtacatatccgctggctaacggtcagacttacggaggcgatatgccgatcgaagaatccggcaatatggtagtccttgctgcagcgattgctgctgtagaaggaaatgccgactacgcacaaaagcattgggaaactctgacaacctggacggattatctggttgagtacggtcttgatccggagaaccaactttgtacggatgactttgccggacactttgcgcacaatgccaatctttctatcaaggctatcatgggtattgcttcctacggctacatggcagatatgctgggcaaaaaagacgttgctgaaaagtacacgaagaaggcgaaagaaatggctgccgaatgggtgaagatggcggatgacggcgaccactaccgtctgacattcgataaaccgggaacctggagccagaagtataatctggtgtgggacaaattgctgaaactacagattttcccggaaaaagttgctgagacagaaattgcttattatcttacgaagcaaaataaatacggccttccgctggataaccgtgaaacttataccaagactgactggatcatgtggacagctaccatggcacaggacaaagctactttcgagaagtttattgaaccggtatatctgtttatggatgaaacgactacccgcgttccgatgtccgactgggtatttacggacaatccgattcagagaggtttccaggcgcgttccgtagttggcggctattttataaagatgcttgaagaaaaactaactaaataaaacaagaacaccatgaaaaaactcgctctattagcttttactttatttagtgcgtggaatatggatgctaaaacgattaccggaccagtggactatgttagtccgctggtaggtactcagtccaagcacgccttatctaccggaaacacttatcccgctatcgcccttccctggggaatgaatttttgggttccccagaccggaaaaatgggggatggctgggcatatacctatgatgccgataaaatcagaggttttaaacaaacccaccagcccagcccctggatcaatgattacggtcagttctccatcatgccgattaccggtaaagccgttttcgatcaggatcagcgtgccagctggttctcgcataaagcagaaacggctactccttactattacaaagtataccttgccgaccatgatgtagtaaccgagattgctccgacagaaagagcggcagcattccgcttcactttccctgagaacgatcactcttatgtagttgtagatgctttcgacaacggttcgtttgtgaaagtcatcccttcggaaaacaagattatcggttatacgaccaagaacagcggcggtgttcctgcaaacttcaagaattacttcgtactggagtttgacaagccttttacttatacggcagctgttgccaatggtaacatcgataccaataaactggaagccaacgataagcatgccggcgcattgatcggcttcaaaacccgtaaaggcgaacaggtaaatgtacgtgtagcttcttctttcatcagccccgaacaggcggaactgaacttgaaagagttgggcaaagataacatagaccagattgcggcaaaaggccgtaaggtatggaacgacgttttgggacgcatcgaagtggaagatgatgatatcgaccatttgcgtactttctactcctgcctgtatcgttcggtacttttccccagaagcttctacgaaatagacgcgaaaggagatatcgttcactacagtccttataatggtgaagtacttcccggctatatgtttaccgataccggtttttgggatacgttccgttgtcttttccctttcctgaacctgatgtatccgtctatgaacatgaagatgcaggaaggattggtaaatacctacaaagaaagcggcttcctgccggaatgggcaagcccgggacacagaggctgtatggttggcaacaattcggcttcagtagttgccgatgcttacctgaaaggtctgaaaggatatgatatcgaaaccctttgggaagctgtaaagcacggagctaatgcggtacatccgcaggtttcttctaccggacgtctgggctatgactactacaataagctcggttatgttccttacaacgtaggcatcaatgaaaatgcagcccgcacactggagtatgcttataatgactggtgtatctatcagctgggtaaggccttgaacaagcctaaaaaggaaattgagatctttgcaaagagagccatgaactataagaatctgtatgatcccgaacataaactgatgcgcggcaagaatgaggatggcaaattccagtctccgttcaacccgttgaagtggggagacgctttcaccgaaggaaacagctggcattatacctggtccgtattccatgatcctcagggattgatcgacctgatgggcggaaaagacggcttcaaccagatgatggactctgtatttatcctgcctcctgtctttgacgacagttattatggcggtgtcatccacgaaatccgtgagatgcagattatgaatatgggtaactatgcacacggtaaccagcctatccagcatatgctgtatatgtacaactactccggtcagccgtggaaagcgcagcactggattcgtgaagtgatggataagctttatactcctgctcccgacggttattgtggtgatgaggacaacggccagacttctgcgtggtatgtgttctctgccatgggcttctatccggtatgtccgggtacggatgagtatattctcggtactccttacttcaaacagatgaagctgcatcttgaaaatggaaagacagtaaccatctccgctccaaataacggagacgacaaacgttatatctcttccatgaccttgaacggcaaagaccatacaaagaactacgtgactcacgaggaccttatgaacggtgcttccatcactttcaagatggattccaaacccaatgagcagcgtggtaccaaagaaaccgatttcccttattctttctccaacgaatttaaaaagaaaaagtaatttatgaagaagcaagtaaaatatatcagtgcgggtatgctggcaggcatgctcctttgtggcggtcagatgcaggctgcaaatacgatgtccggaatgcatgtatgtgtgacggacgctattcagaaagacaatcgtccagaagtttccaaacgtcttttccgttcgaatgcggtagaaaaggaaatcatccgtgtgcagaaacttctgaaaaacgagaaactggcatggatgttcgcaaactgtttccccaataccatcgatactaccgtacacttccgcaaaggcgcggatggcaaaccggatacattcgtttatacgggcgacattcacgcaatgtggcttcgtgactcgggtgcgcaggtatggccgtatgtgcagttggcaaactccgatcccgaactgaaagagatgctggcaggtgttatcctccgccagttcaaatgtatcaatatcgatccgtatgcaaacgcatttaatgacggtgccgttgaagacaatcactggatgagtgacctgaccgatatgaagccggaactgcacgagcgtaaatgggaaatcgattcactttgctacccgctgcgtctggcttatcactactggaaaacaaccggagatgccagcatcttctcagaagaatggattcaggctatcaccaatgtgctgaaaacattcaaggaacaacagcgcaaagacggagttggcccgtataaattccagcgtaagacagaacgtgcattggatacattgaataatgacggactcggagcaccagtgaaaccggttggtctgatcgtctcctgcttccgtccttcggatgatgcgacgactcttcaatatctggtaccttccaatttctttgccgtatcttcattgcgcaaagcagccgaaatacttgataaggtaaataagaagactgctttggctaaggaatgcaaagacctggcaaaggaagtagagacagcattgaagaaatatgcggtatacaaccacccgaaatatggtaaaatctatgcttttgaggtagacggcttcggaaatcacttcctgatggatgatgccaatgtaccgagcctgcttgccatgccttatctgggtgatgtagatgtaaacgatcctatctatcagaatacccgtaaattcgtgtggagcgaagacaatccttacttcttcaaaggcaaggcaggcgaaggtatcggcggaccgcatatcggttatgatatggtgtggccgatgagtatcatgatgaaagccttcaccagcaaggatgatgcggaaatcaaaacctgtatcaaaatgctgatggataccgatgccggaacaggctttatgcatgaatctttccacaaagacgatccgaagaacttcacccgtgcctggtttgcctggcagaatacgcttttcggagaactgattcttaagttggttaacgaaggcaaagtagatttattgaatagtatcaattaatagaataccatgaaaaagttatgtgtatgggcagttgccgccctcttaatggcagcttgtacaccgaaagccgagaaaacaacggattccggtttattgcaaagtaacttccagatggaagtggatggaaagaaaacagatttgtataccttgcgcaacaagaacaacatggaagtttgtgtaacgaacttcggtggtcgtatcgtttcagtgatggtacccgacaaggacggacagatgcgtgatgtagtgctcggcttcgattcgattcaggattatgtcagcaagccttcggacttcggagcaagcatcggccgttatgctaaccgtatcaaccaaggtcgatttactttggacggtactgagtatcagttgcctcagaataattacggtcactgcctgcatggcggtccgcaaggattccagtaccgtgtgtttgatgccgttcagccgaatccgcaagaactggaattgacttacacggcagaagatggcgaagaaggtttcccgggaaatatcacttgtaaagtgttgatgaagctgacagacgataatgcgatcgatatccgttacgaagcggaaaccgacaagccgaccattgtgaatatgactaaccactcttacttcaatcttgacggagacgcagcccgtaatgaggcgcatctgctgacaattgatgctgactattatactccggtagacagtaccttcatgactacaggcgagatcgctccggttgaaggaactccgatggacttccgcactccgactccggtaggcgcacgtatcaatgactacgatttcgtacagttgaagaatggtaacggttacgatcataactgggtattgaatactaagggcgacattacccgtaagtgtgctactctcgaatcaccgctgactggtatcgtactcgatgtatatactaacgaaccgggtattcaggtatatgcaggaaacttcctggatggttcgttgaccggaaagaaaggtatcacttacaaccagcgtgcttccgtatgtctcgaaactcagaagtatcccgatactccgaacaaaccggaatggccttcggcagtacttcgtccgggcgagaaatatatgagtcagtgtatctttaagttctctgtaaacaagaattaaagataagtatattatatcattagtttatcctatcctgtcattcagagcgtagcgaagagtgacaggatgatactattttagaagcatgaaaaacaaccgaagcagatggtatgcccttcttttagtcgtgttatctatcatgacaccgtcagttgcacaaaatacaaagtatgtcaacttgtttatcggtacttccggtgataacggacaggtagctccgggcgctgccgctcctttcggaatggtttgtgtgtgtccggataatgatccgcgtagccatgccggttatgattatgcagtgacgaaagtctccggtatctctgtcaaccgcctctccggagtgggatgtagtggcggaggaggaaacctgcgcattcgtccggtagctccttcacaggaattgcatattaaaaagtcccgcgagaaagcaactcccggatattactcgacagcttttaccaatggtatcaaaactgaattgacagcgaccaacgctatggcggtggaacgctataaatttccccgaagcctttccgctgccctttggatagacttcgcctctacgtttgaagacgtagctacctgccattacaaacgtatatcggaaacttgcatcgaaggctatgtacaggcaaagaacgtctgcggacatggacgctacaaactctatttctccttaaataccagccatcctttccagttggaagaacagaaagagacgactgcctgccttacctttggcaaaaaggtacgttcggtggaagtccgtatcggactgtctgcgttaagttccgaactggcgagctgggaatgtgcccgttgggaaaagatggacttcgaagatgtgaaatcccggaccgctgatcagtgggaaaaacaactgtcggctatcgacgtcaaaggaggcaagaaagatgacagggtcattttctatacttccctgtatcgtacttacctgagtccggcggatgtcagttctccggacggagcttatctgggtacggatggaaaagtgtatatctcagaagacttccgatattacagtaactggtcgttatgggataccttccgcactaaatttcctttgttggtactgaccgaacctgcgaagatgcgggatatggcgacttccctgattcatctgtatgcaacgggaaagaaagactggtccaccggattcgagtctaccccgacagtacgtacggaacatgccgtaattctcttgctggacgcttaccggaaaggaattaccaaccttgatttccgtaaaggatacgctggtatgaagcaggaaatggagcggctgcccatgcgttcgcccgaccagaagatggaatcggcatatgacttgtgggcaatggcaaagattgcggaaatcatcggtgaaaaggcggattccgaacaataccggcaacgttcggtctctctttttgaagaaacatggaaaaaggaatttatgaatgtgactcccgcttttgaagtgatgaagaacaacggactctatcagggaacccgttggcaataccgatgggcggctccacaatacattgataaaatgatagaatgggtagggcaggactctcttcgtttgcaacttacctatttcttcgaccatcacctttataatcagggaaacgaaccggatatccatgttccttacctgttcaaccgacttggggcaccggagaaaacccagcagatagtgcgcagtctgatgaccgaaccgatgatccataaatatggaggcaactcggaatttaagactccttatctgggtaaagcattcaagaatgcccccgaagggtatagtcccgaaatggacgaagacgacggtacgatgagtgcctggtacgtgttcggggcaatgggtttctatcctctgcttgtgggagatgaatactatgatctgacctctccgcttttcgacagggtactgttgcggttgacgaatggaaacgtacttactattcagacagaaggacggaaaaagaaagacgcaccgatcaaaagtatccatttcaacgggaaaaagattgctgactaccgtatatctcacaatgaactgataaaaggcggagaattgatttataattataaataaaccgaattaaaacaaggctgactaaaaagtcggtagtatctccaaaaaaatattcaaaatgaaacagaaacgatcttttaaaataggtgttgcgggtacgctgctgactgtcgggttactgacagcagcttttactacacgcactgccagtgagtctgtaagggtgatggaccgccccgacacagaatcgacgaatgtgaattatgtgagctatcgggccccgctccgtccgttgaactttattaagctgcctgtcggcagcatccagccggaaggctgggtaaagaagtacctcgaactgcaacgtgacgggctgaccggacatctgggagaaatcagtgcctggctggagaaagataataacgcctggctgacaaccggtggtgatcatggctgggaagaagtaccttactggctgaaaggttatggcaaccttgcctatatcctgaatgacccgaaaatgattgcagaaacaaaaacatggattgaaggtgtatttgccagttgccagcccgatggatacttcggtcctgtcaacgaacggaacggcaagcgtgagttgtgggcacagatgattatgctctggtgtctgcaatcttattatgagtattctcaggaccaacgggttattgacctgatgacgaactacttcaaatggcagatgactgtccccgacgataaacttctggaagactattgggaaaacagccgtggcggtgacaacatcatcagtatctattggctttataaccataccggagatgccttcctgctggaccttgccaagaagattcaccgcaacacagccgactggacaaaatcaacctccctacccaactggcacaatgtgaacatcgcccagtgtttccgcgaacctgccacttattatatgcagaccggagattccgccatgctcaaagcctcttataatgtacatcatttgatccgtcgcacttttggccaggttccgggcggtatgttcggtgccgacgagaatgcccgtctgggatatatcgatcctcgtcagggagtggaaacctgcggactggtggaacagatggcttccgatgagatcatgctctgtatgacaggtgacccgatgtgggctgagcattgcgaagaagtggctttcaactcttatcctgccgctgtgatgccggacttcaaggctttgcgctacatcacttgtccgaatcatactgtcagtgactcaaagaaccatcatccgggtattgacaaccgtggtccgttcctttccatgaatccgttcagcagccgttgctgtcagcataaccatgcacaaggctggccttatttttcggaacatctgatattggcaactcccgacaacggtattgctgccgccatctatgctgcttgtaaagctacggtaaaagtgggtaatggaaaagaaatcgtccttcacgaagagactaactatccttttgaagaaggcatcaaattcaccgtttctaccgatgaaaaggtcgattttccgttctacctccgcattccttcatggactgaaggagccgaagtgcgtgtcaacggaaagaagatcagtgtgaaacctgtatccggtaaatacctttgtatcgaacgcgaatgggcggatggtgataaagtagaaatgactcttccgatgtctttgtccatgcgtacgtggcaagtcaataagaacagtgtaagtgtggattatggtccgttgactttatctctgaagattgacgagaaatatatagaaaaagacagtcgtgaaacggctatcggtgactccaaatggcagaaaggtgctgacccgaagaagtggcctactactgaaatctatgctaacagtccctggaactattcgttggtattggataagaaagagcctttgaagaacttcaaagtcgttcgtaagtcctggcctgctgataacttcccgttcacggtggccaatgtgcctttggaagtgaaagctaccggccggattatccccgaatggcagattgacgaaactggactttgcggtgtattgcccgaagaagatgcggtgaaaggcgctaaagaagagattacattgattccgatgggagcggcccggttgagaatatcggctttcccgaatacaaaggagtaactggtgatggaatcagtttacttgaatttgttataagataaatcattttgatttagaaagatataagtgtttatgattgcatcattggcgaaatgactgatttgtgctattatttggaaagaatgttgcctccaaactatcagaatttcgccaattttgcaatctaaataaaagatgttcgttgaactaatttataataatacttatatcaaccatgaagaatttagcattatgggctgtttctgccctttttgtagctgcttgtaccccgaaagccgagcaaccaaccgactccggcctgttaagaactaacttccagactgaagtaggtggtaagaaaaccgatctgtacacccttcgtaacaagaacaacatggaagtttgtgtgacgaatttcggtggacgcattgtttctgtgatggtccccgataaagacggtaagatgcaggatgtagttttaggtttcgattctattcaggattatatcagcaaaccttctgattttggtgccagcatcggtcgttacgcaaaccgtatcaatcaaggtcgattcacattggacagcattgaatatcagttgcctcagaataattacggtcattgcctgcatggcggtcccaatggattccagtatcgtgtgtttgacgctgtgcaaccgaatccgcaagaagtggaactgacttatgtcgctgcggatggcgaagaaggtttcccgggtaacattacctgtaaagtcctgatgaaactgacagacgataatgcaattgatatccgctatgaagcagaaacggataagccgactatcgtaaatatgaccaaccattcttattttaaccttgacggcgatgcagcaagcaatgcagaccacttgttgatggtggatgccgattattatactccggtagacagcacattcatgacaaccggcgagattgttccggtagaaggtactccgatggatttccgcactccgactccggtaggggcacgcattaacgattacgattttgtacaattgaagaatggaaatggttatgaccataactgggtattgaatgccaaaggggatatttcccgcaaatgtgcttcactcgaatctcccaaaacgggtatcgtactggatgtatataccaacgaaccgggtgttcaggtatatgccggcaactttctggatggttctctgacaggaaagaaaggtatcacatataatcagcgtgcttccgtatgtcttgaaactcagaagtatccggatactccgaacaaaccggaatggccttcggctgtgcttcgcccgggagaaaaatacatgagtcagtgtatctttaaattttctgtagataaggaataatctgctcgctcccaagaaataaaaaaaatattttagtctcacggtctcactgtctttctgtaaagatcagataactagatgaataatgaatgagagataccttcggagcagggtgtctctcatcgttttatcccataatatgctcctaaacagtgtatctctcatccttttttaagttgtctctcatcattctttctgctacagactacagctgtattgattttactttacctatcatttgtatgttgtgacacttatgtccttagcatatctcccttacattcttatattatcttaccgacatcttcatcgttccacccgggtgaattgatcattgcacccaggtaaaccgatcgtgtcacaaacgtagacagttcgttctacccgggtggaacgatgaagatgtccttacgaaaaactgataacaataagtgaaaattaagcgattatagggttgcttggacgaagagaaacggtaaatcagacaataactgccgcagtttataattatgtccgttatttgtttgcctttaaagttttggcaatctcttcgaccataaaaggcgtattcttatttatgttttcgccttccaaatgcactgttgtgtatgcttttagtacaaacatgtttttctcgataaatgatgtttcatctcagccttaattttttgaatgattgtagaattcttttttataggtttttctatgattaattgagccagcctatttgccttttctgcctttccctgtttcatgtagacataatgtaacctataaagaggtataaaccttacaggacacattaaggtagctttctctaaatgatgtttggctgcatcatattgttttaggccaatatatgcctctgcttgtactaattctaaattgtaatctgaccaataattacagcaaatagccgttattgctaagcattctttatatttttcggcaacacaaagttcggcagagtaattatataagaaataaggatttcttctaaaagtatgtagtaaattatggtatcgtggtaacatgtcattggttcgtccacagagcgacatatgcgctacttttccccattccagttctgctttaattctgttcaccacttcaataagcaaaaataaacttcctattaataagaaaaaagcaattcctctttttataattgttgttttttgaaacaaggtattttcataggcttttcctattaaagtactaacacttaatgcactaataatccaaatgaagggataagtgaatggataagagaaaaaagaaaaaactgcaatggaaagtaaagagagcagagacacatatcctgctttggttgggtgcttcctgtgacaaagaatcaagaaaataccagcagctatcaaaagtacccaagttagaataccaaactggactccgacagaaaggtattcattaaaaggactcttaatattgtctgctaaaattgcaaattgactatccggatgttccttgaaatattgggcttgataatccatatagtgtgcgctgaatcctccgactccatatcctgtaaaaggctcatgttttatcatttcccatgtgcaacgccatattaataatctaccatcagccgaatctttttttagatgatagactgttacagaaatgacaaatatactaatcagcagaaaggatagacagagtaagaagctaccgatatgttttttatagtggaacttattcttgttttggtgaataaagtaaattactaatacggtaaatatactaattgacccggcgcgagattctgatagcaatactcctaagacaataacaaacaatgcacaccaactggcccattgaacctttttgtttgaatattgtaaaaaatagaaggtaaatggtaaccctgcgcataaacttcctgcaaaaccggcaggattatcaaagctaccgacaacattgtaggtgatggaatgtgaagacagtatattgaaaaattgtaatataccgtatccggcttgaagaaaacaagatataataaccgtgtagtaacaacattttgcattgcaaataaacctttttcctcggaaaagataaaatgaaaaaaaacatccaattactcctaatcctgtgaacataaacatccatttagggaaaatttgggaatctgtaaatgtgtttgcatttacgaataagactcccaaactcaacagaaaatatagaatagaagaaactggaatgcttttcatttatttatattagttgctgtttcaaggctctaagacgaaatatttggtgaaatcttcactgtgagtcgcacctttttcgtctttgaagaaaagatttccgtagcaggttccttgcagctttccttcgacttcgttatattttacaattggcaggtcgttgcatgtaatctctattccagagtaactaatacactctaattcattttttatcggatatacttttttattcattttgtcatatccataaatcacagttagtttataatgcgcgtcatagccgtccctgctggaataaataataccgctttttttcctgcattctaagatttcggtgttccaatttgtcaaggagtcaattttaaattcatcagctacacaaaataaagagcctttttcgatattgtatgaaccattttggattcttgacacagtattttgcaagaggtgaagtatttctttttttctttcttgagagatatcttttttgagaaaagagtagtcaatttgaaaaacagaactcatgacttcccataatttatattcctcatgattaactttttctttgacccactgtggtacttcgtccaatttggagtattcctgagcattgcatttaaatggcagattacaaatccctgcaaaaaataggacgaataataatttatagatggacgtatgattggtacttagaatgttgttcatggtgactattatttttaattgttctataacttttttcaagatctgaatagaaaatcacaaaagagtactaactgtaccaagattaatcttgtgtatattcaaattgatcatgggatcatgaatcctgtcttttgtacagttacctcaacctttctggatccatctttgaatgataaagttccgctacacgatgcggctattaatttcttatccttatcgtaagaaacactggaagcaccagaaaaactcgggtcatttcctaaatatggtgatcccgtataaacactcgatgacgtaattgtaacatcatcatcggattttttgtaagtaacagcagcttttatatagggacctaagctatgtgtatacaatgtacatccatttgtcttatattcagctcctccttctggtgatcttgttgctattctgccaaaatattgtgagtctgatagggtggtgccatcttcatctgctatatttaggaatccttcatatttattaatctgccctttttctattctttcacagatgttgttgatgcaatcatagatttcttttttccttttttctgaaatatccttttttaaaaaggaataatttatttcataccttgaactcatggttctccatagttcgtattctttaggtgtcactttttcactaacccaatcaggaatagtattgagaggagcgtactctggattttcttcaaatgattgcatcggttcatttacaacccagtcttcattttgttcgcatgccattagtgatataaaaatacataatgacattaaatgtcttaatcgattcataagtgatatttatttaaaattaaatggatgtcatgttcttttttaggacttcatactctttttgcaaaggtacgaatcttttaagtgtgaaaaaagggaatgttacacttgattttgtggtttatgattgatattcaaactattatcattgcaaaaaaaaggtattatccattgaattgtaacaatcgtcctattgttttaatctaaaaaagtctgatttcaatacagacaccctatttattacttggggaatgcaataaagaaattccggtaaatcagacaataattgccgcagtttataattatgtccgttatttgtttgtattctaataataattagagtatatttgtaagaatgtataacacaatgaagttaacttgacttcatcaacaaaactattatatgatgaaaaaaatccttttcttaatggtgatctgcgtagccacatcgcttacttctattttaccggcttcggctcagaattcagaccagaccgacgagtacaaaactttactaaaaaagatcatgacgctttccggcagttcggcatcctctgaagctataatgtctcaattgatgtcgagtatgaaaaatgggcctttccaacaagatgaggcttattggaaagattttgcttcaaaatggacacggaagattgaagataaagtcatggaagtatatgctcctatttaccagcaacacatgacattagatgaactgaaaaaagtggttgctttttatgaatctcctgcgggaagaaaacttggggagactgcaactgccgttgcaactgaatcaatgccgatgatacaacagctgtcaatggaaatggtgcaggaaatgatgccgaagcttcagaaatcaagagagttggtaagggatgacgctgccgaacaggccaagacacgcgatcaaaagttatttgatgcggcttatacagctcctaaagatagcatagagatcgttgccgatagaacctatgagcatggcatgggtacaaagcctttattgcattctattgaaagaaggaaagatgatactaaagtaacgttcctgcaacccatctatttcgactggcaatggatgtactatagcccgggatttaaaatagtagataagaaaaccggtgatgaatacatggtgagaggatacgatggtggcgcacctatggataagttgatgattattaaaggttgcaatcgtaaatacatatatgtcagcctgttgttccccaaattgaaaaagaacgtgaaggaaatcgatataatagaggcgctgactgataaagaggagttgccttccaatgatgacggtaaagctaagtcttattttgatgtaaaagtggacgattatttggtactttccagagaaaacaagaaagtctattattgattggacagatttatctatcattgaaaatgaatataactataaaaaacacaatggtttggattataaccattgtgttgatgtccattgatatatatatagtattcatggaccctttggaacggcaatatgatttgacgcaagttgtaatagcttggtatcttgtaacgttgctgcttgacttcctttttcgtcataataaaatttatggggtgataaggaacattatagccacagtgcttctctgtgtattctattttgtatttccttaaatgtataataatatgagatatgcagttgttttgataatcaatattatattggtgttggcaggcttctttttactttttggtgatcctttgaataaacagcttccaacgaaaatgatagctatttggttcattgttttagtgatattagattatcctctccgtcataataaaatatacaaagagataagaatattggtatacattatttttcttgctcttctatattggttgtttccgacataggtaaatcattgttttattcatattcatgctcaaataaaatagcctgttaatggatttgtataatgggaatgttttatctttgcagtgtttaaaataagatacgatgaataaaagagtaacaatacaattcgctgactttataaagagtaggttggcaggtggtttgctctgttgccttgtattgttggctgcttatctgtttcagatgtttttcccaggaatgtatgttgatgcattctcgtcatctttttatctttttgcgtggttgattctctttgtgggcgcactcctatggacacttcgtgagaaaggaacatctggattaccctccgagataactgattggcaatgcattgctgcctttttgttgattgttgcaaatcagatttatgttgttatgcctaaggaggttcacgttgaattggctcctgtaatatctgcttatactttacctgtgctggtcattgtcagtttggcaatagcagggatagttaagttgtctatctcattctatcgttcattggaaattgaacggcaaaaaacaattcttcaagagaaacggcttcaggaactgctgtcttctcctccacctgtgttggaaggcgtcatatttgtgcgcagacttttagaaaatcaatctatatatcaattaactgccagtgagaaccttacattaatagaaggatgccgtgcgattgatcctgacttttttgtttggttaaaagataagcaaataaaaattcctccacgtcatattgtatattgtgtacttattaggatgaggaaaactaagaaagagattttgtctatttttgatattagcgatggtgcttgccgtgccatgaggtctcgtgtccgtgcgagcttaggtatagaagatgaggacatggaaacctttttgcaggagttacattaggtaatctctagtatgtttattagtcctataaaagaatggattgctgatataaatcctcccataatagcgtagtagaaccatacgcgtttattcgaatatttgttttgagggaatgtgtcgatggctccgattatgagcacaatccatgctagaagttcaaagaaagtaataaggaagtcttgaagagaataatttatatcatcaataaagcggtgaaagtaacacatagtgatgctaatcccccacattatattatataagattatatatttaactattttcatttattagctatacattctttgtattccttgtttgctatatctttggctctatcatattttgcagctgcttgtattaagcagccagatggcattgaaccattttgacagttagcgatagcattgtcataatcagcttttgcctgcttatatgccgcttgtttttgttcttcacagctactagtacttcctccttcttcgcgtgttttcaggagttttacttttgtaagttcgttactttctgcatatagtataaagagttgtgtccgttcatctgcgcttaatcttaaaaatcttgtatgtttaatcaggttttctttagcttttgccagttgctgtagttcattttctagattggctttcctcatgaagtcttccacgtagtcatcatcattcagattttccataagtttgtcatattcttcttcacttaaaatagaagtgtactcatgaaacttatcagctaaaagctcggagctcatttcgaattcccaaaattcatctgaactggcgatggaatcaataagagtgcttccattatttatcatttttgatgaaagtgcacgtgtattagttacctcgtttttttctatttcgtcagagtaatatccgtctgcgctacaactataaataaaaaaggaagctaccagtccgcaggctaatgccattacataatacaaagtgtattttttcttttttgtgatcatattctgttttatttaaatgtgtatgcaaagtaacgaaaaatagacttattttagggataataatcattcaataaaaggaaaatatttggtctagtgtcaatttggtcatgtttgtgatgttacaatttagtgtaaaatatgaaggagaatcgctcctagaaagctcacaggcgctatatgatagcttattggtgtaacacattcgttgttaaggtttagtccagtcgttattatccgaaataaaaaattaagcttaactacttactgataagtacaagacttgataatgagaagtacttaagttgtctgattcttgtacatcagttgagtaaaagatgtacaacgttggagtagacgatgtactacgattgaactaaagatgtacagcgtttgatctatactattaggatgtcaaatctgaaagggctgaatgttggtatcactttaaaggataatattcattcaaaaaaggataatatgtggtcagagaaggaaagtttggggtatttcggttgttacaatattagggaaaataaaaaaatatcctcgctgtaatcctcctgtggcacattctacatgctgtaggagtgtaacgccctctttttctatggcaaaagaacttgtaaatttgcagaaaaataacacgaaatcatttatctctatttttctgataattatgaaaatattcacaaagttggtatctgtctttttgctcgtagcaattggtagtctctttttcttttcatgtgctgaaaaagaaaaatgcactccaatggtttcattccttgaaaccgctcttcagcaggcaggagagaaccgtgtggaactggaaaaggtcttgtctcattataaaactgatccggcggatagtttgaaatataaggccgcttgttttttgatagagaacatgccttattacacctattataagggcaagcagttggaccgatatcttacttactatactttactacaggaaacacgtggattggggatttctccccaagtagtggctgactctgtttgtcacatgtatggggcattgtatttagattctttgcaatcctatagagatattgaaactgttgattctgcttatttatgtaataatattgaatggtcatttaaggtgtggcaggaacaaccatgggggaaacatgtttcgtttgcagatttttgtgaatatcttcttccttatcgtattggtgacgagaccttgactagctggcgtgaatctatttatcagaagtataatcctttgctcgattctttacgtgcatccggagtacttgataaagaagacccgattgtggcagcccgttgtttgctcgattcaattcgtaaaggaggagtggtatttactactgccgttcctgccagccttcctcatgtgggaccggaagttgcgcaactgaaagcaggtagttgccgggaactttcagactttgtcgtttatgtttgtcgtgcgttgggtattccgtgttcaattgatttcatgccgattcgcggtgatgagaatgatagccatcaatgggtagcattttcagataagtatggcatactttattatcatgaatttcctaacggtgtgagtgaagtacgaaaagacgcaatgtgtggaatgcccaagataaaggtctatcgcaatacctttagtctgaatcgtgctatgcaggaagaaatgctgaaattggatactgctattgttcctcttttcaaagatccgcatatcgtagatattactttcccttataccaaagatttcaagaaagaactccacataccaaaggacgctctatataaaggtaagccacgttcaagaattgcttatctatgtgccagcaaacggatggattgggagcctgttgcatggacagagttcgatggtaaaaacattgtctttacggatatacaaaaaggacccgtcatgcgggttgccacttacgagcgaggacgacttcgtttttggaccgatccttttgaaataaatgtttccaatgagtttcattttttcactccttcggatagtgtacaggatgttactttgtttgcaaaatatactttgcgggcagatgagatgtttttgaatcgtatgataggcggaacatttgaaggaagcaatgatcctgattttcgtgaaaaagaagtcttgtacttgataaacgagaaaccgaaaagactacagactgttgttcaatcgtattcttcaaaatcgtatcgctatgtcagatatataggtcccaaagattcacactgtaatattgcggaggcggctttttatactcctaatgataccgcttctttaaaaggtaaagttataggtactcccggatgttttcaaaaagatggttcgcatgagtatacaaatgtatttgatggggatgtcacaacttcttttgattatatcgaaccttccggtggttggtcaggtcttgatcttggaactcctaagcagataggaagaattgtttatacgcctcggagttatgataactatattcgttcgggtgatgattatgagttattctattgtgcaaggaggaataattggaaatctcttggagaccaaaggtctaaagcggactcgctgatttatatcaaaattccagtgaatgctttacttttattatgtaacaatacacgaggaatacaggaacgaatatttgtgtatacagcagctgaacaaatttggaagtaaattcagatatgattttaataaaaacttgatttattttgctaattgtcatttattaagctagcgatatatgatttagtaaagatgaacaagtttaataagtaaataattattaatgattaaattttaaaattatgatttcgagaaagaaaagcctttttttaagcgtatcagtattgattctatttgtggcgttagttgcacaaagttgtagttcggagaatgacgattttgttgctaatcccaactcatcattagaaatgagagctaacctagaatcaatggataatcgtgcaacaattgtcaattctatagccgaatctgatgaattattagattacggaatgaactgtatgttacttgctgagaagttaaaatcatatacttcaactttgactccagaagaatttgatgaacttatgaataacttaaataatgatgattatatgatagaacttgtgagtaaggttgacattgaaaaagaggctttaatggtagagaatgcacgacaggaactattagctaataaaagttttaagttgttagatgagtccgaaaaaatgaatgtttttattagattctctgataattcgcagaatactatgcaacatctattgctaaaaagtccgggtgaaagtgcaggaggtgttactaaagcggaatgtaagcgtagatatgatgaagactacgcttatgcttctgctatttatctatcatctatgctcctttgttcttgtgcaacgggggggcttggtgtatgtctttgtgctattggtgcttctgctggctatgactatgcaacaactcttgctgatcgtagttattatgattgtttgtcaaatgctatagatcgctaaatgaggtattataatatctttatagttttagctatactatctgtattgctcatgacaattaatagaaactataattatttgataaatgactggtatatttcaggtgtttatgtgttaatgtgggtctttctttttctttatacagtaagtaaagttcctaaaaagaaaaaaggcttgaaagaatatcttcctagcattttagcctttcttgtggttctattaaatgtcttggatgtgcttagaagacatgttatgtgttaaaataagtagatgaaaacttaggaataaatacttaatgttttgtggtttataatcaactttttatttattcctaagtaataatgagtttttatatgtcaaaagtgagtattactcaaatcggctttgctcttctttgcattggtagtgtttttatgtattctacccagataaccgatccctatattgtttctaaatggttatatacgatcttatttgttttaattataacaatatattgttcaattagaatgttattaggaaaatctgtaaaatttgatacacgattggctgggatgagtattgttattgtttctagtttacaagcaatatatggtctgtctcaatgttttaatataaccacctttaatactttttataagataatggggagttttgaaaatcctacgggattttctgcttgtctttgtgtcagtttacccttttttgttgtattccaattattaaatgaaaataagcaaatacggtatctagtatgttttttagggattattgttgtaatagcaattgtactatcatattcaagagctggaattattagtgttgcaatagtaattgcgatatttttgtttcaaaagcttaaacagaaaagaatttggaagtatctattattatgtagcagtctgatattattgttgtttggttgctattggatgaagaaaaactcagccgatggtagactgctgatttggcaatgtggtataaatatggtaaaagatgctccttggataggtcatgggttgggtagtttcgaagcgcactatatggattatcaggcaaatttctttaagcaatgcggacaaagccgtttttctatgttggcagataatgtgaaacaaccatttaatgaatatcttggacttcttttaaattttgggattattggtttattagtattgttgttattgatggtaataattatatattgctataggaagaatccaagtgtagaaaagcaaatagccttttattctttgtcttcaataggaatattctcgttcttttcttatccatttgcatatcctttcgtttgggttgtgacatttttaagcatattcataataactagtgaatatatcaaacctttattttctaatatcctaataaagaaaatagcttgtatgttcatacttacatattctcttttcgggagtagtaaattgttcgaacgtattcaagcagaattagactggggaaaagcttctacgctagcgttatgtaagtcatataatgaaactcttccaacctatgagagattagaaaagatgtttgtgagtaatccctattttctctataattatgctgctgttcttcaagaaatgaagcaatataccgaaagtctagaagtggctttaaaatgtcgtcaatattgggcagattatgatttagagttaataattggggaaaattaccagcagcttaacaaacctgaactggcggaaaaatattataatagtgcatctatgatgtgcccttcgcgctttctacctctttataaactattccatttatacaaaacgaatggtgaaaaagaacgatcgcttgctatggctgaggccgttattagcaaaccgatgaaaattaagacaactactattaggatgatgaaaagagaaatggaaagagaaatacaaaaaatgaatatgtctataaaactagaatgaatatggaattaatacggttgttgtcaatcacttcgcttgtgcatttaggaatctacggattgtttattgtgtgataatagaaataaatatagtaaccgaatgagaatttataaaacactaatgaataaaacattcatttatctgctaatagcagtattggcagcttgcaaaagtactccttactctgatgaaactactaaaagtgaccttcgtgcgcctgcttatccgttattaactttgcatccgcatgtgaaactttggtctatgacggatgaactgaacaaacagaatatgacttttggcggcagcacacaacttccttttgttggcttcttacgggtagacggtgctatgtaccgttttatgggtagtaaagaactgccgatgcaagctatcgctccgatggcgcttgaccatgaaaagtgggaaggaaagttcacttcattagttcctgatgaaggatgggagcaaccggattttgatgacaagtactggcaattgtcagaaggggcatttggcacgcctggcatgtgggaagcaagaacacaatggacttcttctaatatttgggtacgaagagaggttgaagttgatccgtatcttctggagcataaaaagatttatttgcgctattctcatgacgatgtatttcaattgtacatcaatgggaagcaattggtgaataccggatatgactggggagcaaactttaaagtggaagtcccggactcaattctgcaaacaatgaaaagtggaaaagcgttgattgccgctcattgtgagaatcgtgtgggaggaggattggtagacttcggactctttgccgaggaaccgactatgccggtggaaaaggtagcccccatctcttatgaaaaagagtggacgggaagatatactatggagcaacctcaggaaaattgggaagccaaagagtttgacgatacaacatggacagaaggacaggcggccttcggcacggatgatcaacgaaatgtgcatactccctggttctcacctaatatatgggtgaggcgcgaactgacattcgacccggcgttggtgaaaaacaagcaactgtatttacgctattcccatgatgatgtatttcaattgtatgtgaatggaatgcaactggtcagcacgggatatgagtggaaaagtgatctcagagtaaatatcccggattctattgcagaaactatgaaagatgggaaagccgtgattgccgctcattgtgagaatcgtatgggaggtgcattggttgacttcggactatatgcagaattgagggaagctgaacaaacgtctgtcgatgtgcaagcaacccaaacacattataccttcgaatgtggagatgtagaactgaaacttagctttaccgctccttatctgttggacgatctggagacacttgcccgtccggtcaattatatctcttatcaggctaaagcattggatggcaaagaacatgatgttgctgtttattttgaaatagacccgcacaaggcatttcgtgccggacaatctacacaaatatatgaaaaggatggactggctctgatgaagaccggacaggaaaatcagaaattatgggtggataaagagaaagatggacggtcatggggatatttctatctgggaacaaaggatgacgtgacctgtgcacagggggatgcagccgaaatgagggcatactttatgaaagagggagatctgaaacaaatgagaaagtctgccgagaaacgctatgctgcatttgcacagaagctggatatgaacagcgatttcccgcaacatctcactgcagcctttgacggactgtatacaatggcttatttcggcgaggacttaagaccttattggaataaagacggaaaatcaagcatagaagatttgtatgcagatgcagagaaagattataaagaagtgatggcaaaatgttatgcttttgaccgtcaattgatggcggatgcttaccttgccggaggaaaagaatatgctgaactctgtgctttggcttatcgtcagtctgtatccgctttccagatgtctgaagattcggatggagaattgctttattttactccgcaggtaggtccggtggatgaatattatccggcttcaccactatatcttcgctacaatcccgatttggtaaaagcgatgcttaatccgttcttttattatagtgaaagcgggaaatggggaaagccatttcctccgcatgatttaggaggatatcctatcgtaaacgggcagacgataggtggtgatatgcctgtagaagaagcaggaaacggattgataatgactgctgctattgctaaaatggaaaagaatgcttcgtatgcagaaaagcattggaagacattgactcaatgggctgagtatttattggaaaacggcacggataccggtgatcagcttactacagataattttgcagggaactgccctcatcatgctaatttatccgccaaaggtgttttgggtattgcagcgtatgcacgtctggcagaaatgctgaataagaaagaagaagcggagaagtatatgaatgctgccggtgagatggctaaagaatgggaaatggctgcttatgcgggtgaccattaccgactggcttttgaccaaccggatagttgggggatgaagtataatctggtgtgggacaggctgcttggcttgaatcttttcccggagagagttattcagaaagagacggatttctatcttactaagatgaatgagtttggatgtccgttggatagcagacatagttatacgaaagtggattggacagtatggactgcttcgttgagtgctgaccgtatgcaattccgtaagcttatgttgccgcttcataagtttatgaatgagactacagatcgcacaccaatggctgatttgataaatacggatgggaaaactatagtaggatttacggggcgtactgtagtaggtgcctattttatcaggttgttggaaaaggaataattagaatcttaatgtcttttagaaggtatattcggagcaatatgatatagttgatttattattttaaataaaaacattatgaatatgaaaggtttattttatttagttgttactatggtagtaataattgcatgtacaaatgaagagtttgatgctaattcagaagttaagaaggaagaagttaaaacaaagattgcatcattagctgaaaaatatgatgtaaacgtcgatttctttgagattaatccttcagaaaaaactgaaaatgagatgtcattagaagaaattgaagaattgtttcgtgatataaaacaacttagagaacaccctgttgaattaaagatgtataaggataaagaagaaaatggctgtatgttttattctactaaagagcagaaacctagtgtgccgcttgctaaaacacgtagtgaaatttattcattcagtgattggatttggaatcttacatggtttagtgtaactttgatcgaagataacaaaaatgtaacagtaatgacagatataacaggattatcagtttatacgtattctcaatcttatgcgagtggctatgtatcaggaaatgctatatcatttaatagtacggggaaaattaaggcaactataactcaggttgttggctttaacctttcttatgttattaattcttcagggacatacgataagagtgcgggaaagggaagtgttacagtttctgcatattaatgattattgagaataaaaattatgattatgcctccaatgttttttgaaattgtttatgttctgattttgttgattgggatattggtcgtgttgaaaagtcatcaacttactaaaccatataaatatttatgggtcattttggttttgttatttaatctgttaggcataattgcctttttgatatggaaacagtatcttaacaaaatgagcaatagtggatcgcatggaaatgtctgatttgatatataatatgaatcgggtaaacttttttctctatgctctttgtaaatccgggatggattgaatagaccattgaaactggttgtttttctttgatttagccaccgttattatgatggtggctaaatttcttatcttagataaagatacaggaggtgccccttttttcataaatgccattgtcgtttctgtctataaccataaaacatacttgaaatcggaagtttttaggggtatacccctaaaaacttccgattaattatttatatttgtgtctataaccctaaaaacttcagttgtatgattaatcgtgaactttatatggagcaaatcactccttttattgataagccatttgtgaaagttatcactggtattcgtcgctgtggcaagtcggtcgtgttgcgtttaattcgtgaggaacttttacgaagaggagtatctgaggattatattatttatatgaactttgaaagtttcgagtggatagacatgaaggaggcgaaggcgttatacgctcatattcgggaagctacgaaagccccgggaaaatattatattctcttggatgagattcaggaagttacagattgggaaaaggcagtgaatgcctttttggttgacttggatgtagatatttatgtgacaggttctaattcacgtttactatcttccgagttttcgacttatttggcaggaagatacgttgcctttcacattatgactttatcctttagagaatatctattatttcatgatctcccgctgacaatttctgtatccgaccgtaaaacggagtttctgaaatatcttcgtatgggaggatttccggctattcatacggcaaactatgattataatgctatctacaaaatagtgtatgatatttattcttctgtcattcttcgtgataccgtgcagaggcatagcattcgtaacgtagaaatgcttgaaagagtggtgaagtttgtttttgataatattgggaataaactaaatgcgaaaaatattgccgactatttcaaaagtcagcaacggaaagtagatatcaatacgatttataattatctcaatgctttagatagtgcttttgtcattcaacgtataccacgttatgacatcaagggcaaagagattctgcaaaccaatgaaaagtattttgtaagtgatctttcattaatttattctgtgatgggatatcgggaccgcttaatagggggaatgctcgaaaatttggtttgcatggagttgaaacgccgcggatacgaagtatatgtaggtaaacaggatgaaaaagaagttgattttgtagccattaggcgtgaagagaaaatatatgtgcaggttacttatcaacttggcttgcaagcaaccatcgattgtgagtttgcccctttactggcaattgatgatcattatcctaaatatgtggttagtatggatgatctatggcaagataatattgaaggggttaagcatcggcatatagccgattttctacttgatgagtggtaaagacggactaaagctttagtccgtctaacaaatctaaataaatcccgatagcctcttctatctctttcagcataatatactcttcggctgtatgtgaacgtgaagagcgtcccggaccgatctttaccgatgcaaaggacatcaatgcctgatctgacaaagtcggggaaccgaaaggtatgcgtcccatcttcaccgctttctgtacgaacggatgtttctcatcaattcgtgaagaattgagacggaacgagcgggctttcgcatcgcaggctatatgctttctgatctctgcaaataaatcttcgttggagtaaagttcgttgcttcggatatcaacaacaaatgtacatttatcgggaactacattgtgctgagtgcctgcattgatgaccgtaacgctcatttttaccggtccgagtaaaggtgattctttctcgaaacgataatcacggaaccaggcgatatcgttcaataccttataaatggcattatctccttcatcgcgtgcggcatgtccggcttttcccgtagcagttacatccagtaccatcaaccccttttcggcaatggcaggttgcatctccgtaggttcgcctacgatagcgaatgaaacagggggtaaccccggtaatacactttcaattccctccttacccgaaacttcttcttcgcaggaagccagatagatgagattgtaattttgagaagtgcgacatagttgcaggaacacctgtaagagcgaaacaacactggctccggcgtcgttactgcccaatccgtataatttaccgttttcctcgcggggtgtgaaagggtctttgcgccagccatttacgggttttaccgtgtcgatatgagaattgagcaggattgtcggctttttaaggtcgaacatagggctgaggcaccaaacattgtttcctttgcgtccggtctgcatcccttcggcttcgatataattttgcaggaaatcagcggcttgcgtctcttcccgactgatggacggaatgctgattagtgatttcaacaggcttacagcttcggctgtcatggttggaatatcgtatttcatatacaaacttgttaatttagagcttaatatttgcacaaagatactcgttttgcgcaatagtttcaaataaaaatataaccgattttaggaggggggtacaggaactatctaccattagttctttagtgggaaatgctctgttaagaaccgaatttaagtaccactttaaagaaccgtttttaagaacatggaagtaacagagcaacatttttttgatttaagtttgaattacaatttacgcaatcccaagagtaggcgacctactattatatatgcggtatttcgcatttcagggaaacagtataagattaacatcggtgcaaaggtttatcccaatcaatgggatagccgtttgcagatgccgattatgcacaatatttctaatcttgatgtttgtaataacaatgtagttctatcgcaaattaatcaaacaaagttggcatttgataaagccaagtcgtatatttgcaataatccgcatgaattggagtatccgaagcggtgtttagagattatcaaacaaaattttaatttaaaaccttatactatgaagaatagggactcaataactcaatggctcatggagtacattgaggcaaataaacgtggtaatacattagtgaaagaattacagaatgtaaacttcttaaggcgatttttcaaagaacatagtcagtaccaagatgactttacccaaattagttttgaaatgataaatgatgctttccgttatatggaacagatgaagcagcctaacgggaagcagtatgcagtatcaacgatacgtgaggcgcaaaagaaacttaaggcggctttaaaggttgctgcgggtagagagttccgtaaatttaattggcaggcaacagaaattgatgaggtgcaaatcacgaaaaaccttatacctaaacctgaacggggtgcaaagaatgctccccttactgctgacgaggttacaaaactacgggaatacgagtgtagtggtagcagtaaagtggcaagggatttatttttaattcaatgttatacagggcagcgtaaatcagacttaatgcagttattggatagtaagaatatagattggagtaagggtattattacagtcaataagcagactaaaggcaaatgtgcagcatatattccgataaaagatacattattggtaaatctgataaaaaattatgagggacaacttcaacgattacctgtaaaatataatgataatttgcggaaagtggctaaaaatgcaggattgacacgaatagttgaatatacggagcagagagggaagattgtcgaagaacataaagggcatatctatgaattgatacataatcatttagggagacatacttttataagccgaatggcagaagcaggagcacgtaaagacgaaataaagtctattacggggcatacttgcgacagtacagttgatgatatatacacgcacatagaccaactgaaagcagcccaaaagggggcaaaacatcaaaggggattgtatgatactaaaggaaatgatacagtttttttcccacaacaagcggcatctaataatggagtagtggatagtggcatattagatactgttgttgatttaaagattaaatgtcgggatttgcaacgagaaaagcaggaacttgcttcaataattgctcgccaagaatacgaagatgccatagaagagattgcatggcttccccctaccgaagaagattttgttatacaccctgttgggtaggtgtatcgttgccgaatttgtgtgaaaatatataattgtgaaattacgggtagaagtacttgtagggggctttttgtgttttggaactactcaaagtcagatgaatttgcgcaagtatggtatttagtgtatccccgctcttagaattgacgtatgtttcaacctatctaccttacagccgtttgctgtgtacatcagaaaattttctgtaaaaatagtaaggttaaatattgaactttcctactcttttaactacttatttgtatatgataataaattaataatatgaaagaggaaacaaaaaagaaaatcagcgcgtgtttacgagggcgaaagaaatcggcaactcactgcaaacacatttcccaaagtcttcaagcattgaagaagactaaagagcacagagaacaccttagtgtttcattgaaagaatatcataaaaataacaaagtaaaatcagaaagacatgaggaagaacaagagcgtaattagcattgataaattgaccctttgttatcgggcaacggatgaagttataaagaaattgaatgaatatgataaattggaagatagtgataatagttttacgcttgtacgtgtaccaagtgatgaggctttattcgccaatagctatcatgtaatggtttcttttgatgggtccggtaggacgcatcaaaagaaattcgccacattaaagacgaaattacatagcatgggtgaggatagggctaactatgtatggctctatattgagaattgggttttctatgaaatttttgctttttatggaaaaaataataaatgtaattggttgagctgtgttgactatattgcggatgaattagggttaagcctcaacaacattacaaatttgcacgtggctttggataccaatattaattttgccaagaaaatcaaacatgcacagttttgcgatgattatgaggtgatattgaacggaaaggtacgctctaataagaaagaggtgttggatgaaatcttacacatacaaacgggagaccaatgccgtttaagaacgttaactgtttatataagtccaaagaaacaagacggattgtcattaaaggtatatgataagaaaagggagttggaaaaatcaaacaaaaattatattccacaatggaacggacttaaaaataaaaactatcgggtggaagtagcaataaaaaacgagcatttaaaagagttttatcaatggaaaggtgaagttatccccgatgaattgctgatggttacattagcgtcaaagttgcaaagtcaagatttgctctttgatatgctgtattatttttccaatagattactgcgtttccgttataatggaaagtgcatttcaattttccaactttgatattaaggttgcttttgatgggggtattagcaaagccccctgcgagagcagccttttttgatttaattaattatcaattaatgttatatgtggtacaaaaatgcgtagcattatattattttgtattcaaaaaataattgtattcaaataaatctatgagtatataaaagaatacatttaaattgtattcaaaatattctttgattaatttgcatacaataaaagaaagtgttatctttgtcgcataataaaaagccaaattatgaaagcagtaatatatgcacgtgtgagttctacaaatgaccgtcaatcaacagatagacaagtggttgaccttatgaagtatgctgaatatgtaaaaatggatgttgtcaaggtgtttgaagaaaaagtatcgggtgcgaaacggaactctgaacgccctgttcttactgaagcattgaactattgtcgaacggaacatattgatatgttattggtttcagaattaagtagattaggaagaaatgctcttgaagttctttcaaccgtaaaagatttggctgatgataagattaatttatatcttcataaagaaaagtttaccttacttgatgataatggtgaattagcaacatttgcaacaataatgcttgcaacactaagtacttgtgcacaacttgaacgagagaatattaaataccgtttgagtagtggacggaaacaatatattgaaaaaggcggtaagcttggcagaaaggaaggcagtactaaatctatggacaagaagaaagaagagtacaaaggtgtccttaagtaccttaaacagggattacctataaggcaagttgcaaaattaactgatgtgtcagcctcaacagtacaacgactaaagaaagagttcgagttgtaaattaaaagagcctcacttggaggctcttttttgtcgtgtacaatatcagtcagggatatactgtattgtaccattaatgattgtttcagccttacctttgtagtttgtaaaactaaaatctttaagttcaagtgtcaaattcttgccattgatactttttacaattacagtaccacgtggatttgaagcaccataaacctcttcatcactcatgctcgctcctaagaagaagaatagtttgcgtgaagaaattattaaatgacttcctgcttttaaattaccaatccctgtaaagtctttaacttcgccattatccgtatctttatatttttcgacaaggaactgaaactcataccaagaggtggcattttcactttctttaaaaactgcactaaagcagatttcattgcttgatacaatttgacttgctgaatagtctacatagtcagcactaatgacctgataggtattaactgtacctgtagcagcatacttaacagatactttactgctgccattaccgtcatctgtgttgtcgtcatcgtcattactacaagcagataatgcgaacgatgaaatagctacaagaaccataaacgatacttggaaaacactaataaatttctttttcattttaaataagattaatttattcagcagacccgactgaacgttaatataaggaaagaggcgtgggtactgttagttcatctgccgccaaggtatcgccaaacacccacaccacaaaagaacaacagcccacgcccccgtataacgagtgcgtgagcatttagttgtccatatcctctgtggtgcttaaaatttggcgatttttggcagcaaggatataactaaacgcttcttcgtttaaatcttaatatgtcgttgcaaaggtatgaaataaaagttttatctgctttatattgttacggaaaagttctatctttgcaatgttctttatggagtaaagaaccacttttaataacccctcttttaaagatttcattatcagtatagaattagtttcaaataaaactaatacctttgtaccatatttatcaatacaaagagtatgacttatcatcatttatctgtcttggtccaccgtcaggctgaaaagtatggcgacagggtagcattgagataccgcgactatgagacagcacaatggattccgattacctggaatcaattctccggaactgtacgacaggctgctaatgctttcgttgcgctaggagtggaggaacaagagaatatcggtattttttcacagaataaacctgaatggttctatgtcgatttcggcgcatttgccaatcgcggggttactattccgttctatgcaacgagttcacccgcacaggcacaatacattatcaacgatgcgcaaatccgttatctttttgtaggcgaacagtatcagtatgattctgcattcagcatcttcggcttttgttcctcgttacaacaactgattattttcgaccgttcggtagtaaaagacccgcgtgatgtctcttccatctattttgatgagtttatggcaatgggcgaaggattgccgcataatgaggtggtggaagaacgtaccgcacgtgcttcttacgatgatttggctaacatcctttatacttccggtacgacgggagagccgaagggagtaatgttgcatcattcgtgctatctggagcagttccatacgcatgacgagcgtctgacgacaatgaccgacaaggacgtttctatgaacttccttccgttgacacacgtattcgagaaggcatggtgctatctttgtattcataaaggagtacagatctgcatcaaccttcgtccggcagatatccagacaaccattaaagaaattcgcccgacactgatgtgcagcgtaccccgtttctgggaaaaggtatatgccggtgtacaggagaagatcaatgaaacgacaggattgaagaaggcgctgatgctggatgccatcaaagtcggcagaatccataatctggattatctccggttgggaaagacccctccggtgatgaatcaactgaaatataagttctacgagaagaccatttattctttgctgaagaagacgatcggtattgagaatggaaatttcttcccgacagccggtgcagccgtgcccgatgaaatcaatgaatttgttcattcggtaggaatcaacatggtggtcggctatggactgacagaatctacggctacggtatcatgtactttgccggtaggttatgatatcggttcggtaggtgtggtattgccgggactggaagtgaagataggtgaagacaatgaaatcctgcttcgtggaaaaagtataaccaaaggatattataaaaaagcggaggctactgccgctgctatcgatgctgacggctggttccatacaggcgatgccggttatttcaagaatgggcagttattcctgacagagcgcattaaggatttgtttaagacatcgaatggtaaatatattgctccgcaagcattggaaaccaaactggtgatagaccgttatattgaccagatcgctattatcgcagatcagcgcaagttcgtttctgccttgattgttccggtgtacgggtttgtcaaggactatgcgaaggagaaaggaatcgaatataaagatatggccgaactgttgcagcatccaaagattgtcggtctgttccgtgcacgaatagagaccttgcaacagcaatttgcgcattatgaacagatcaaacgcttcacattacttcctgaacctttcagcatggagcgtggagaattgactaatacattgaagttgaaacgctcagtggtttctgaaaactacaaagaactgattgagaagatgtacgaagaataaggcttttctcggtctagcctgatgataaacgataaacggtgaacaagctgcatatttggcaagctgttcaccgtttgttctttgtgtatcaattggctatgtatctgctattttatagagaacactatactttagtaaccgaagatttgttcctgagtgagttcctcgatagggcctactgctttcagcttattcatatcgaggtctttcttgtctcccaagatgcaatacacatacgtgcgtcctttcacccattccttttggaaatcaacgatatctttcaatgtcatagtctgcacgtcattatagagtttgatgcgcggatctacgctttgtcccaaatcctgtgcattgatataagtccagataatatcgcttttgatgatgcggtcggtacgcatgcggttgattaatccttcttttgccaatttgaaggctgcttcggattctggcatattgttgataatatcgttgaacgtattgacggcatcaatcatcttgtcattttgagttgcaatctgggtacgtatcgtatatggatacttcagatagcttggcggcattatacccgcccatgcggaataagccagtccacgtgtttcacgcatttcctggaagacgatggagttcatgcctccgccgaaatattcgttatataattcgcgggtaggttctatagccggatcgtatttcttatcaagattggaaatttgcgccatataaatctgtttggcttcgtaaggagctaccagcactttggtcgccggagtttcaagataagagtattcgtttcctgcaggaatatctttcagagtagccggtacctggtggtattgttcgatggtagccagcaggtctttgctgctgctagggccataatacaggatacgatgtttgtagttgttctgattatgaatccggtcaaccagttcctgtggattcatgctggcgagctctgcttccgtcagtaaattggtggcaggagacttcgggccgtacatcgcataattcatcaggcgggagaagttctgtccttgattcagtttggcatctgcacgggctttcagtatatctccgaccagattgttgtaagcttccttatttacttgtgcgtctgccagtaacttttcgaatagttgcatggcagccggcatattctcattcagaccggaaagaaccacgtaggtgcgttcgttgcccggagaaacgtagaaagtacacgccagacgatagaactcgctcttcagttcttccggtgtcatgtcggaagtgcccagatattcaaggtagtcgaaagccgttcccaatgccttgtcgttgttgttacccatatcgaatacgtagatcagttggaagagatcgttggtagtattctgcttatagagtaccggaatatcggatttcgctgtcagctggctcatatctttcttgaagtcgaggaatacaggttcgatgggcttcactgcattctcctgtatggaggtaaggaatggacttgccacatcccggttggatacgatgggagtaatctccggttttgtcatcttcttctcgttcgggtccttgccttgtttcttgtagacaacggcataattatcctccttcagatatttatcggcaaaggccacgatatcctctttggtcagtttagccatgcggtcgatggcggttacttcgtcctcccagtttgttccgttaatgaatgagttgacgaatatgtcggcacgtccttcattgctttccatgctttggagctcgtagagcttgaagttgttgatattagcttgcagcatcttctcatcgaactctccggcacgaagtttctttatttcgttcagcaagaggtctttgacttcttccagcgtttgtccctgtttgggaagtccgcccaatatgaaggctgagtaatctgccagtcccatcgggtaaccgtagctgttcagcaccttctgctgctggttcagatcaaggtcgatgagtcctgcctttccattgtataatacttgcgaaacaacttgcagaacctcgaaatccttgctggccaatccggggaatctccatgccagtgcaacgctttccgcatccggacctaatacttctttaactataggtgcggtgatcggatcttctttcggcagattcagtttgggaagttccggattcggcttcaagcctccgaagtatttatctatcaaggcaatggtttcatccgggtctaaatctccggacatacagatcgccatattattgggaacgtaccattgtttatagtaattcttgatattggtgatggaagggttcttcagattctcctgtgtacccaatacggtttgtgttccataaggatgcttggggaagagagaggagaagatcgcctcctgcactttgctgttgtcccgggtcagagacatatttttttcttcgtatacagcttccagttccgtatggaaaccgcggatgacattattctcgaagcggtctgcctgaatctttgcccagttctctatctgattggaggggatatcttcctgatagacagtctggtcataccatgtgtaggcattgctgccggaagaaccgatagcagccatcagcttgtcatattcgttgggaatggcgtatttggatgcttcgtaagagaggctgtcgatggtgtggtagatcgctttgcgctctgcttcgtccgtcgtctggcggtatatctcaaattgctgttcaatttggtccaatagtggtttttcggcagcataatcctgtgtgccgtatttgtcggtacctttaaacatcaggtgttcaaagtagtgtgccagtccggtcgtttctgccgggtcgttctttccgcccacccgcacggcgatgaatgtctgaatgcggggagtttccttgtttacagtgaggtaaacttttaatccgttgtccagtgtgtagatgcgggctttcagcgggtcattgggcactgtctcgtagctatacttcttttgtgagctacaactgctcatcactaatgcaaggaagagcgataagcatgaaagtttcaggagtttgttcatattgtgacaacattttagtgacagaaacaaaggtagcggaatttttcttacctttgcaccgaaaagagaaatttgtaaattgtaaatgataaaattgtaaatcacatgattactattgaacaacttaaagacgtgaaagagcgcactgatgcgctgaggaggtatctttgacatcgacgggaagaaaattcaagtcgaagaagagcaactaagaacgcaggcgccgggattctgggatgaccagaagaaagcggaagcccagatgaaactggtgaaagacctgcaaaagtggattgacggctataatgaagtcaagacactggcggacgaactggaactgtcgttcgatttttataaagaagaattagtgactgagggagatgtggacgcggcttatgcgaaagccagtgaagcggtagaagcactcgaactcaagaatatgctgcgtgatgaagccgaccagatggcctgtgtgttgaaaatcaactccggtgcgggtggtacggaaagtcaggactgggcatctatgctgatgcgtatgtatctgcgctatgctgaaacgaacggttacaaggctactatcgccaaccttcaggaaggggatgaggcaggaatcaaaacctgtaccatcaatattgagggagatttcgcttatggttatctgaaaggagagaacggtgttcaccgtctggtgcgtgtttctccgtacaatgcgcaaggcaagcgcatgacatcgtttgcttccgtgttcgtcactccgttggtggacgacagtatcgaagtgaatattctgcctgcctgcatttcatgggatacattccgaagcggtggtgccggtggtcagaacgttaataaggtagaatccggcgttcgtctgcgctatcagtacaaagacccttatacgggagaagaagaggaaatccttatcgagaataccgaaactcgtgaccagccgaagaaccgtgagaatgcaatgcgccagttgcgctctatcttatacgataaagaattgcagcaccgcatggcagaacaagcgaaagtggaagccggtaagaagaaaatcgaatggggatcgcagattcgcagctatgtattcgatgaccgccgcgtgaaagaccatcgtaccaactatcagacttcggatgtaaacggagtgatggatggtaaaatcgaggaattcatcaaagcctatctgatggaattttcatcgcaggaatcataaaaacaaaaattagcgagtgttatttttggaaagttaaaagatttgtttttactttgttagcgttgaactttaaagctaacattatgggtaaaagtaagagaaaagtagcacatagtaagaaagaggaggagcaggcccagcgggtagtcaagatagtatttgtttcactcattattttggcactgattatgctgatcgcatattcctttttcggctgattgattcaccacaggttacacagttttgcatggacggggacacgttgattgtcgacggtgaatatccatgctgacgagggtagtccgtggtgaattctttttttgtaacccctttgttatccgtgtaacagtattgtaaccattctgtaatttcaccgtatctcttttgtaatctctccgtatcctgctcattgtacctttgccgcgaattaagtagcaaacaactgaatgagtagaattacaacaaccgtcgccctgcttttgatggcgacagcagcctgcggacaggctaaagaagatgccggggatggcaaacaactggataagcagaccatggaactgaaagattatttgcctgaaattcatggaacgatccggggaaaatatgagtttcagacagaaaccaacgaaagccgttttgaagtgcggaatgcccgcttcagtgtttcgggaaatgtacatccgattgttgcctataaagcggagatcgatttgtccgacgaggggtccatcaagatgcttgatgcgtatgcccgtgtatttcctgtcaaggacctgaattttacgattggtcagatgcgtgtacctttcacgattgacgcccatcgttctccccatcagcagtattttgccaatcgttcttttatagccaagcaggtgggcaatgtgcgtgatgttggcttcaccggttgttatacacaaaaagaaggtcttccttttgtccttgaaggtggattgtttaacggctccggcctgactaatcagaaggaatggcataagaccttgaattattcgataaaagcacagttgctgcctaataaaaattggaatctcactttgagcactcaaatgataaagccggaacatacccgtattaatatgtatgatgccggcatctactatcagaataatcgttttcatatcgaagcggagtatttatataaaatgtatggacacgaagcgtttaaggacgttcatgcggtcaatagctttgtgaattatgatttgccgttgaaaaaagtattcaataagatttcttttctggcccgttatgatatgatgactgaccacagtaatgggctggcggacagtgagacaggtgttttgaagataaacgactatgcccgtcatcgtgtgacaggcggcatcacgctgagcctttccaaagcctttattgctgatcttcgtctcaactttgagaagtatttctatcagaagtccggagttcccaaagagtcggagcgtgataaaatcgttattgagtttatgacgagattttgatttttaattatctttgtgctatggcacaagaaatagaacgtaaatttttagtttccggtgattttaaatcctttgcatttgcgcagagccggattatgcagggatatatttgcagcgcccgtggtcggacggtgcgggttcgtattcgtgacgataaaggttatctcactatcaaaggtgcttccaacgaatcgggtaccagtcgctatgagtgggaaaaggaacttcccttgtccgaagcggaagaactgatgaaactttgcgaaccgggaatgattgataagacccgttatctggtacgtagtggcaatcatatcttcgaggttgacgagttctacggtgagaatgaaggacttattgtagctgaagtagagctgggcacagaagatgaggcgtttgtcaagcccgggtttattggcgaagaagtgaccggggatgtacgctactataactctcacctgatgaaaaaaccgtataaaacgtggtgaatgttaacaaataagctgtatatttgttcctagtactaaaagagcagtatatggaacagttgtacaattatctaccgagagaactgataactttcgttctggttactttattttctttacttatcggactgtcacaacgacggatcagtctgaagcgtgaaggggaaacaactctcttcgggactgaccgtacatttactttcattggtattctaggctatttgctctatatactcgatcctacggatatgcgtctgtttatgggtggtggtgctgtgctcggtttattgctgggcttgaactattacgtcaagcagtctcaattccatgtttttggtgtaacgaccattattattgcactgattacttattgtctggctcctattgtttctacccagccttcctggttttatgtgatggtgattgtgacggtgcttttattgacggagcttaaacacacttttacggagtttgcccagcggatgaagaacgatgagatgattacgctggcaaagttcttggctatcagtggtatcatattgcctatgttaccgcacaagaacctgattccggatattaatctcactccttattctatttggctggcgacggttgttgtctccggtatctcgtatttgtcttacttactgaaacgctatgtgtttcatgaatcgggagtattggtttccggcattatcggtggattatatagtagtactgccacaatttcggtattggcccgtaaaagcagaaaggcttccgagcaggaggcgaacgaatatgtagctgctatgctgcttgcggtcagcatgatgtttctgcgttttatgatattgattctgatctttagcagggagatatttacatctatctatccttatcttttgattatgtctgtggtagctgccgttgttgcgtggtttatccattcccgtcatcgacgctccaaggatatgaccgatgagtcggaagatgaggacagcagtaacccgctcgaatttaaagtagctctgatttttgccactctcttcgttgtgtttacagtgctgacgcactatactttggtttatgcgggtacaggcggattgaatctgctttcttttgtatccggacttagtgacattactccttttatcttgaaccttttgcagaatacagggagcgtagctgtactggttgttgtggcttgcagtatgcaggctattatcagtaatattctggtgaatatgttttatgctttgttttttgcagggaaaggtagtaagttacgtccctggattttgggaggattcgggacggtgatcggggtaaatcttgtgttgcttctgttcttctatttgtagaaaaggggggcatcctttttgttgccgaatacactcaatagaactggcttatattttgtttttttgaataaagaaactatctttgtatttagatataatagtatctgaatagtgctatttttaaattaattgaatataattgtatgcctttactttataattttgatgtagagagacccgaagagttgctggcaattctggctcagaatctgcagaaacgcaggcttgagaaaggactttcccgagaagctcttaccgaacttagcggagttccgacgcctactattgccaagttcgaacaaaagcatactatttcattggcatcctatgtggcattagcaaaagcactgggttactctaaagctatcaaggaacttttatctgaaccgctgtttagtacaatggaggagttggaaatgattaataagaataaaaacagaaagaaggggcgtaatgaaatcagtaaataaactgatagtaacctatcatagtagaagtgttggaactctcagtatgacacctgataatcggctatgcgcatttcagtatgatagagagtggttggctaatgggttttctatctctccgcttgacttgcctttaaaacctgatttgtttattgctaaaccacaacctttttggggaaactttggtatttttgaagacagtctccctgatggatatgggcgttatttacttcatcgtttactcaaaaaacaaggggtgaatgatagcgagctaactcccttgcaacggttgagtatagtcggaacatcagggatgggagctctttgttatataccggagacatacattggcgaagaaaaatctcttccgacactagattgccttcagcaaatggcattggacatactgtcagagaaatcgtatgaggatgaagaggtactttactttaatagtggcaactcaggtggatgccgccctaaatgtttacttcacgatacagaaggagcttggttggtgaagttcaggcatacatatgatccgaaagatatgggagcgatggagtatcgttataatgaagtcgctcgtaaatgtggcataacagtaccggactttaaattgatggacggaaagtattttgctaccaaacgttttgatattgaaaatggtattaggtatcatattgctacggcaggggcactacttaatgaatctattatgcaacccagattggattataagactttactgcacttggttggttatcttacccaagaccctaaacaggtagatgaaatgttccggcgtatggtgttcaatgtcttaacggataataaagatgaccatgccaaaaactttagtttcatttataaagaggggaactgggcgttagctccggcttatgacttgacccgatgcaataacggatataatggagaacatgctacctctgttaataatcatggtaatcctactatagaagatatgctgattgttggagagagcattcgtattcctcggaaaaagggaaaagagatgatattgactattgcagaagggtgtgctgagttattatctaaaaaaggcatctgagaaacagatgccttttttaatgaagttatttagaaatcaatatcgttcatgctattaaccaataactgatatttaatatatcctccacttttagaagaatatttggtataaatagcggtgatattacctttggcaccatctgcaggcagaggctgaagtgcgaagtttgaatatccgctgacacgcaggatatagttgccacctgtagatgtcgcattgtcataagcaaaccaggaagaaccataatagcgattacctccatagctgtaagcataggttggagtcaatccttcttctgcataatatttgttttcatatacagcggtggttgaaccgttcgggtaagttgtttccagatattgaggatacttgtcgccgtcgtatgtgccttctttgtaagtcagtccttcgaaacgtaccaaacgtcctaatgcatcatcattcaattctgttttataattattttcattgataaccaatatgtcgtcttctgtcagactgccgagttcacctttgaatacatgttgatctacaaataaggtattctcgagattacggtttgcataacctttggaaatgtcttctgctgtcggcattccacctacacttaacatataacgatagctaccgatagccagacctttggttttaacaaagagagtctgccctacatgaaaataaacatagttgctaaccatcaatttcagttcaatggctgatttggatgattcatcatagatgtatactgatttgtatacattaccggcttggtcgcttgagatgacttttccgctgatgacatagtcttctgtgatttccagagtttttcccagactggctgcaccgtttccgtattctttatagaaaagttgcttaaagtccttgatggagattagtttgctatttgagaagtcttcttttgtccagactttggctggagcaggctcttcaaattcgttgtagcagctactgaaaccgagcactactaccgcaagcataaataatttaaatattttgttcataactgttctttttacttatgatgtccttagaaacggaaataaatgttcatgtaataggttgtaccgaacatatagaaatatttcgaatcaaacggttggtaagtttgataactttcatccttgttcttcagcagacgaacttgttcataaccgccggtcttgatattctggttgttgagcaggttctttacctccaggctgaaaccaagagtataggcacggttaatgtaccagttcttaccaacacttgcatttaaaacgcaagcagagttgaatttctcctgattacgtaacgttgcgatatcttcttcagtcattcccggtgtcagtacggcatctgtacgatagagcggactcatagataagtacatattattataatagttcatatctaatgacgcaaatatgtttttaggaccacggtaagacaagcctacgttcagtgctgtttgcggagtgctttctacacggaagttcttccagtatactttaccctggtttttgatttctccactattatcctgaatctgtacataatccgggttattgtcataagtgaattgtccccagctgatggctgcattcagagaaagtcctgcatagataggtacagaagctgctgcttcaagtccgaagtgacgtttgttgataccgctcattgcaaagttggagaaggtagcttctacgtcatcataataagagagaactttggactgatccataaacttcgtatagtatccggagatacgtgctttaacatccccccaacgcaagttataagaggcgtctacaccaaataccttctcgcttgaaatacccggagtcgcagagttgcgggtacggggagaaacaaatgaagcttggaaggcaggagcatcctgcatatagatgatgttggcatcaatagaatgagcagcagagaacttatagctgaagttggctttcagtttataagtcaggtaattctgcttcttagagtctccttgagaattgtcaaggaacaacccttttttccaaataccatgacgccacagagtagtatgtccgagttctccacccagattgactccaaagttgccgaagtttctgctatattgtgcccaggcgcgtgcgttgataatatttccgtagtagtcgtagctgtatttatcacccttcttgacagcttgggcatgaccgtacttatcatagtactccatgttgttctggtaaaggattgggttcataccacccatgtcacgttcggcaaacttgtctacgtctacccagtaatcaccacccagcaaatctttcacttcgctataatattctgtgcgattacgacgcaagttcaatccaccgttaattttagaattgtcacggaagatatgagagaattgtgtgtagagattccagtctatctgatcggcatggcgttcttcaatcatgttgatggcacgatgaccggctccataggtcgggttctcttcctggctttggttgatatgatacaagttgtcccagttgatgtggcggatgttattagtatttcctatccatgcttcatacagttgtgctccgacgtaagtgttgttatagaaactcggtaaataacggtaatagtcgggacgtgggtcgggaccaccgtaccaagtcagcgcagagtaaccgttctgtccgaaacgtacagaggttgcaacgtttaattgtgaacggtcattgatgtcgaatgtataattcaacatcgtaataggttcatgatagctgcgcacacgtgcgttgacacgctttccattcagccaaccccagtttggattgtagtagttgttgcctactaagtcgtagacttcctgagtagaagcttgttgtgcaccacgttctgtgggagcacccaggatgcttaatgccaagcggtgttgtgaattgaattgcttttctacagcggcaaaatatccgaaggcattgtagtacacaccgtttacataagagtttcctccttggcgggttgatacggagaaggcataagaccagccgttatcctgtaatccggatgcataggtcagcataccacggaagcggtacatggagttaccgttaactacgctggcgcgaaggcctttgcgcatctgtgaaggacgggtattgatatttgttgtacctgcgataccgccgatgcccatatcccccatgttcagtgcagatgtgacttcctgattacgagtcgcatcattcaagccgctccacaaagaccagggagtatatcctgtcattgcgtcattcagttgaataccgttcatataaacgtcggagtattgagaatcataaccacgtacattgaaacgcatttcactgaatttgtaggaagcgatgttattgaatacgtcttttgatgcggacagagacgagggaagtgattgtgcatcctccagcgtttctgtgtcaaattcggcaaagatagcatcgtccatcgtaggagcaacgttttcagggatcaaaatgacgttattgatatctctgatcaacttatccacacggacagccagagttaaaggttcgaactctgcagcttcgaaagacagagtgtattctccttttgccaggttttcgataacgaagttacccgacgcatcagtcttggttgttacatctcccggggttaatgtcacttttacgccgtctatggccgcacgtgtcgtacgggaaacgactttacctttgactccaccattgttttgtgcaaaaacagtgaatgacatcaaagataataccatgaataggattgttttgattttcatataaacttatttttttatttacctatatagatatatacggggaagtggtcactgtaacctccctggaagttattacctacgtatgtgcgcaatggatatcctttgtattgtccttctttctgcaccatgtaaagttgcttgaagatatttccatagaatttagatccgggagcttgctgcaatttcagctttcctgtcgatccttttgctaaattctcggatactacaatattatcaaagatattccaggcatctccgtaggctagtgttccgtatcctgctttgagcatatcggcataaggagcgaagaagtcgccttccttcaaatctttcagtttgaatttggctcctaacccttgtgctatacttttgtcggtcggatcatcattgaagtctcccatcataaccactttcgtgttaggattggccttcattacagagtctgcaatgctgcgcatctgttcgcctacagcgatacgtttaaattctgaagcttcttttcctcccaggcgtgaaggccagtgtgctaccataaagaagaagggttcgttttcaatcgttccccaaagcgtcaggatatcacgggtcttgaagtccggaagtgaagggatgactgttcttacagctttttctccttctattttaaacacatcgggacgatacagaaaagcaacgtctacaccgcgggcttcaggagagtcgaaatgtgaaatccgatagtttgccggagccagtttgcgggttgcgataatatcttccagtacactgcggttttctacttccgatacaccgataattaccggataatccttgttgatagctgcaatatcgaagaatacacgttctgtgttagccaacttcttattgtacttggctgagttccacttcttaggaccttcgggagtaaattcatcatcgtgaacttccggatcattgattgtatcgaagaagttctcaagattgtaaaatacaaccttatacggtttctgcgcaaagctgaacgatatcagcagcgcaaagagcgcggttactaataacagttttttcataagctagcttattagttaatcccccattgagtgggattattttgttgttttacactgttggatacttgtgggaagaaggtaaatcctgtcatcttttcgatgtctgctacagaagtacagatagacttaggaggttcaatgtttccatacgatttgtgatctacccaaaatcctattgatatcagttcactgtctgaacaatctttgatgttctttcctgtttttccactcttcgtacgcagaagtactttgaagtagttcgtaggaaccggaactgtattccttgctccatccgtagtggtggttgcacctgccccaaaatatgcgccggtaactacatacaaggtatcagaacagttatttgcccgaacttttgtttcaagtttagcccacatatcctgattcaaacgattaagctgtggggtcatattggacatatagaaggtttgagcattcatttcgtctgttcctaggcgatcggctgatggaagctgatgaccacggtcataagatcctccataagatcttaatgtacaatcagcctgataactttgaggaatgatagggtcgaaggcccaacggtctgtacgttctcctgaacctttgaggtatgcgttatgtatcggataggctacccataaagctgctttctttgttttatcaaaacaaatagaataattacgtattgttttattattcaatagagcataatgagttacatactgataattagcattttccttgaaatcaggaacttcagcccacagtttgaaagctggcaagttctgctgtgattcagataattgtactaaatcaaagactttcgcctcttggtctgcaaactggagtgaaacttttgctacacgttgttctttacctgtattgctattataatacacgtataaaacattgagtccgtcttttatttctccggatttagaggataaggtcagatcattgctactgaaagaacaccatgttgtgccctcagtgatttctgcattccatattgtcccaggagtacctgtgatgattatggcagacgatccggatgccgattttacagtggaggaaattttccagtaggcatcacctgactgtgacgagcctccaccgttggagtcatcattgctacatgcagctataaatagtataagtgcagttaaccatattgatttagaaataaatctatagtatttattgggtggcattattagttattatatgggtttaagacaatccagtcttgatagaacatttctaccaagactggaatatcattattctagaaggatattattctgttaatctgtagatggttacgtctacttgagttcctttataacaagcaaatcgatattgattgttattattattccattgtaaattacgggcagcgtattttactggaataattttagtaccatcaaatttccattggaatccatcttttatagaactatcgaagtgtaaattattaccatcttttgtcaatcccaaataggttgatccaagtagaatagtatattgatcttcactaccttctaccttagctatagtacatgcatattgattggtctcatcatttgccgctatagtttcattagatgaattataggctgataaaatatctacatatccggcataatcacctgcgccttttcctgataaaacattgactgtcgttccatcctccttagtatatgtaatcaaatacttcccactccaatcagaaggagccgatgttactttttcatatacttttgttacggctcccttagcatcttgttttacaactacatttactttgctatttccaagagcaattaccagggtctgttcaacggctccaccgttattctctattgcagtaactgtaacaacattgccttcaacggatgaggataagttaccgcttaagcctgtagctgtaataacatttgctccttgatttgcagtggtaactgtaattgttttagtaccaccagttgaaaggaagcttaatgaagatggatctacttcaacaattgttggttcagtgactttgaatccgctcacgtcttcaagattacgaggtgctaattgtcctgcactttggtagatggaagcaatacccgtcattgatgcagttgttgctgcatatggctgattatcgaacggagttgcgttcttgtttatattgacagtgaatgatgtccctgcaacattgaatgtgtgatttttgccagcatcagcatctttccacactcctcctgttgcaatattgacattttcaactgtaacaggcatacatacaaatgctgctagttgggataaagtgacttttacaggtgttacggcattgtttgcagaaataacctcaatattatctgcgctgaatccttcaacttgaggtacatcataacgtttatatattttggctacatctttttgtaatgttactttgatctcttgacctaatgcatattgagttacatctatttggttgttatataaagaaagtgcattacccgctgtggtagctcctttgctcatcagataaagagtaccataagagtagttcttgcctgcagggtcaccacaaataataccttgaattacatagttttcatctacagctgtggaagtacttgtcatttttgttactaagtctgctatagaaataggagttgcagtagactcgatagcgacaaatgttttaggctcaccgtaaatagtactagaagcagttgttgcataagcacggaatgcatattgattgtctttagtcagattagtaacagctactgtccaaggattttcttttaccgatgcggctgttttagtcgcttttgtccaatcaatatctgttacagttccggtactgaattcaatatactgtacaccaacttcggtggcttcagaaatctcaatattagcaactgaaccacctaatgttgcagtggtagctgtgatggcttttgcatctgttgttgttactttaggttctcctgctgttccaaaatcaatttcagtaccaccagcacctgttgccaaagtgatatcatctaaacgaatagctgaagcatctaaagctgtgaatctgatatataggttttcaggaacttgttttaatgtgaagtttgctgttgcaaaaacccaataaggataatcggcatcgccattattcttagtatatgtaattggtacccaagccgtaccatcagcacttaatgcaacttcaaatttggaaacatcgaaggtgttgtcgtatgttccgttattgttcacagaacggctggctccaaatgtcaattgcagattcttttgttcggaagtaagcgtgatcgtattaacattgaagtttgtaggagttttgccgaaaaatacaacgttaggtcctgatgcacctgcataagcatctgtatttgctaatccactattacggactgaagcatttacgcctgtataagtaacggattctgaaccgacccctgttttattccatccttcgtatttatcaacaaaaggccaattcgttttatcaagctcaattgtaccaacattgtcgttatagattactacagatggctctacgcttccactgctaatcttaacagtctctgacatcaacacacccactttatttgaaatctcaataacaacgctggcttcatcattaacgttttccggaatgctaacctgaatagtagcagaaccttcaccttcatattttgatagagtaacccatgatttgtcatcctttactgtagctttccaactacggttggttgaaatgtcaaaagaagcttggcttccgttggctggttgaccgtctaagccgaaaatcaaggttgtaggcgaaacttcgaggtatggagcctcggtatcatcattgtcgtcaacgcaacttacgaaagctgtgctaaccattacaagcataagcccgtagaataacttcagaaagttcaaatttctcattttgttgctttgttaattaattaataaaatttttgtgaatcatttatcattttgttctctctcgataataatagtttagcaaagttatttttttctatgaaacgtgcaaagtttctaacgtctttttcatattacaactgtgttaaattttagtgacttaagaaccggcaatgaggtgattttcgacattgacgaatagattgattctttttatcttcaatatataacattgtgaaagaatttagagatgtttgttacttttttgaaagatttgcattatgcctttattggacttggccttgttagcaattgcactgtttacggagtattaatagaaatatttttgaatggacttcatttataatttgatagatagaatcctaatggtataaatttattttaatatttggatgctgaaataccgtattgggaatgaatgcgtctttttactttcatcttgatggtggaatcttattgtataaactatttatttcttcttttgtgctctgattgccgaatgttttgtgatgatcttgttgctttgatcttcatccacaatttctcccaccatccactttcagctttacttagcgtatcagaagttatcgtgattatcttttctctcaacttgttctgttcggttgccatcgcatactgcttttccaacactgaaattctacgctttttgcattgaaggtcttgctcttgtagctcaatgacttcaagataaactttgcatacttcggattggttattgcagagttgttccagcgtatgaatgtagtctttggtgggaagggtttcgtgccaacacaagaatttctgaaggctcttttcgtcaatgataagagtagtctctgtgaaatatgcggtgattgcttccatttctgcccacaaacagatgtcttcttctttgactccgtacttgtgcgccgcttcgtctatgctaatccatttcggcatagtgtttctttgtttatgcgtttaacaaaaagagcgaataactcttgccaagcatggtgcaacaagcatccctgcattttgctttctagtcggagggttatggggtatggggattatgtaggggaaccgaccggatacaaaagaggcatggatgctgttgaaccattatctgatttcgaggcctagcaaaacccttgcaaaagataatgataacaacagacatccacgccaatcgtttatatataacacatctttaactgatatgttgatatacagccatccacgtggagtatctgttgtatcatctctctttgcatagaaaattgctagttttcgaaatcgagagacaatacattattaatactcctatttaaggaataaaaaacactacccgcttattatatctcgctgatgcgcagaaagtgtacagcaaagatatatgttttttcggaataaagtgggagaatgggaataaataaaagaagtctggtatttagaatgattttttgtgtttaagtgatgttatttcaaggtgttgttgccattaatatcacttagcacatttatctccttcgtaaagcaatgctttgtatcttcaaaagctatgctttatggttgctaaagcattgctttaaataaccatacagcagatgttacgagtgtcgccttcaccttcactttttcctctcaaccttttattaatcagtgatctcgggtgaagggacggctattcacctagtgagtggagaaaacattgtaagtgtttgaaataaactatcaatggtttgaaacaaacattgggaagaaaaaaataatctattagcatctttttattaggttatagctaatacgaatatcattatagcaaaaacaaattagcttatagcaaagtgaacgatgtctttatgattacatatgaaaattgggtgaaggatcggtgaagggcgatatgtttcacccgttatcacttatgaataaaaggtttcgaagaaaaggtgaaggctacccttctatttgaaaatttatagtatggcgtataaaagcatctggctttgatgggaagggggcgtttcagcgcaagaatttctgacattatacaactcatacaagttgcttggtatatggttgatgcaagctcaagagaagggaaatcaaggtgatgcctgcatggaagtggatgtgcaataaaatgaaaaacgattctctgatatatcaggaattacttgatattaatggcaaataaaatatgggttctaaatataataccttttagtgtacaacttaatctcttttagtgaatgaattaattcgtctgcctataggcaacctttcgtccggctataggcggacgaaaagatgcctatagccggacgaattaatttatgaatgcggtgacgttattttctacagagaaaacctttattcaattatgccgttgttcttaagattttgaagatgtatttataatgtgcagccaagaaagacctctgccattctatgacctagaaatcggtttctcttttcgtataatcttttttatctcttcttttacgattcttaactccgaagatttcgtaaccataaagaaaccatctacttttaccccgtatttgtaagaaattgaaagaaacttcgtctaataaactaaaaactaaaacgattccaaacatgaaacacagattgttgctactattactattcgtgttcaccgcagtgatgacaggttgggcacaaaactccgctatgccgtcctatactgtcaaaggggtacttttggattcactgactcaggatggagaaccatacgctactattaagattactaaaaaaggagcaccggacaaggctgtcaagatggcggtgacgggtgccaatggtaggtttcaggagaaactgaatgtaggtgcgggagattacgtcattactatttcttcgataggcaaggcgcccgtcacgaaagagttcactttgaaaccatcggttagagtcattgatttggggacaatgctctccgctgaggctaataatgaattgaaaggagtggaagtcgtggcgcaaaagcctttggtcaaggtggatgtagacaagatagagtataatattgaggatgaccccgactcgaaatcgaacagtatattggagatgcttcgaaaagtgcctttagtgacagtggacggagaagacaacatacaggtgaatggtagcagtagctttaaaatacacgtcaacgggaagcccaacaatatgatgagcaacaacccgaaagaggtgttgaagagtatgcccgccaattccattaaatatatcgaggtgataacatcgcccggagctaaatatgacgctgaaggagtgggaggtattttgaatatcgtaacagtaggtggtggattcgaaggatatacggcaacattccgggcaaatgccagcaactacggtgccggtgccggcggctacgcaatggtgaagcaggggaaaatgactgtctctgccaattacaactttaattacaatgaccggccccgtggatattcggacagctaccgtgagaactatgagtcggatacggaaaaatatcttgaatcaaatagcagttccaagtcgaaaggcaacttccagtatggaaacctggaaggcagttatgagatcgacaccttaaggctgctgacggtggcttttggaatgtatggcagcaatagtaaaaattatggtgatggatttaccaccatgtatggtgctaaccatgaggacatagcctacagctatcggaccggcaatcatggagatggctcctggtattccatcaatggaaacatcgactatcagcgcacgtccagaaagaacaagcagcggatgatcactttctcctataagatcaatacgcagcctcagacaagcaattctaatactggctatgaagatattcacgccaaagaggaggtggacgacctcgtgaaacggttgctgttgaaaaacagccagtcggacggcaaaaccaatacgatggaacagaccttccaggtagactatacgactccgataggtgagttgcataccgtggaggcaggtgcgaaatatatcttccgtcgcaataccagtgacaacaaactttatgaagcagccggaggaagtgatgattatttatataacgaagaccgcagcagcgactatcgtcatttgaatcatatcctggccgcttatctcggatatacattgaaatataaggatttcaccttcaagccgggagtgcgctatgaacagactgtgcaacgggtgaaatatatcgttggaccgggtgagaattttcacacgaacttcagcgacctggtgccatccgtctctcttggcatgaagcttggcaagactcagaatatgcgtgcaggttataatatgcgtatctggcgtccgggcatctggaatctgaatccttattttaataatctgaatccgatgtttatcacccaaggtaactcgaacctgaaaagtgaaaaaagccatgcgttcgacttgtcttatagcaattttagtgcgaagttcaatatcaatgtgtcgctgcgccattctttcaacaataacagtattgagaatataagccggttgattacggcgcctgaaggggagatgtttgacaatgatcctacgcacatagcaccggaaggagccttgtacagcacttatgccaatataggaaagagccggaacacaggaatgagcctgtatctgaactggaacgcatctcctaaaacgcgcctatacgtcaatggccgtggaaactacagcgacttgaaaagtgaagcgcagggattgcacaattatggatggaacggttctttctatggtggcgtccagcatactcttccgttgaaaatacggttaagtctgaatggtggtggtagtactccttatattaatctacagggaaaaggttctggctattattattatagtttgggtgcgagccgttctttcctgaaagatgagcgtttgagcctgaatgtgtattgcagtaatatatttgagaaatacagaagctataacaatcatacggaaggcgtaaacttcctgtcgaagagcagcagcaagtggccgagtcgtagctttggagtcagcatcagctaccggattggtgaactgaaagctagtgtgaagaaagctgcccgaagcatcaataatgacgatgtgaaaggtggtggcggcgaaggtgggaatacaggtggaggaggtggtcagtagaccacttccacgcacgctgtgatttctttatttctgccttacatcctgcttattggtattgaaacctaacttggtaagtcctgcttgtacatcgggatgactcatgaagagtttccataacagccctgtccggtaattctcgatcatgactgcaattggtccctggtcgatggcaaggtaacgttgcggataccagttgtctgtttcgctgaaagcatcgtagaatccgaaaggaccgaagactgtgtcccccatattatacaggtggcgcatcacttgcatcgaatattccggtgtatagacgatggatgaaagggcggcggtgggagagatgacccctttgtcatcctgttcattcggtgaatgagcagcgtatccatcgacggaatagctggcagtcagtccccagcagtccggtccgaaacctttgtagtgtttggggttgcggatgcagtaagcacggttcactaatgtcagattgcgcatttcgtggaagtagctgggacagtattcgtctttcagaccgacggggtcgagtccgaggaaggagtattgtgcccagaaaagcggtccggcttccgtgccctgatagcggagatgcagttcgatgccttccactttatgtggggagacgatagctccgttctgcgcccagccatcgtgatagacagctgccggtactccgtgggtaggagaggctgcggcaaggatatacataatcatacattcgttgtacccatgtatggggaagtccatttcccagccataggtggggctccagtgccagtatagcacattttggtcaccgttgcggtaccagttccagtcaacgtctttccatatttggtcaatgcgtgctgccagtgctttttctttctcattaccgttgatgtaatactggtgtacggcgagcagtccttgcatcaggaaggcagtttctaccaagtcacctccgttatccttctgtccgaaaggtttcacctttcccgtatcgccataccaccagtgcggatatgctccgtgaaaacggtccgctttttcgaggaaggagacgatgcgctccattcgtgccagaccttcttcgcgggtgacgtacccccggtctattccggcaaggatagccatgatgccgaagccgctgccgccggaagtgactacattggcatcattctgcggatataccccgtctacatgataccgttcgggggcaagtccgctgttgggctcggcaccttcccaaaagtagagaaaggtgcggcgctgaacggtgtccatcaaggcatcgtccgtgagctcggaactggcggtggctggtccgccggtcttgtttttgcaggctcctgctgtcagtatcaggcagaggagcgaaatatagagagatagttttttcattgattgtggatttaaatgagagaataaaatttaggcatggattacacggatttcacggttttaagagatttcgcagttaaagaccgtgtgaatccgtgtaatccatgcctattgtacgatttttattttagcgtgaatcgtgcggatttcacgtcccggctgtttgttccgatcattacttcaaattcacccggttctgctactagttgcaggtcgtagttgtaatatctcagcatttccggtgcaatcttgaaccgtacaatttccgactgtcccggttcaaggaatatcttctggaagcctttcagctctttcaccggacgggtagtgctgccgacgaggtcacggatatagagttgtactacttccgatcccggccatgtgccggtattggtgaccattactgctgccgtcagttctcccgtcatgtcgatggtcgaacggctcaggtcgatatcgccgtaagagaaggtagtataagacagtccgtatccgaacgggtaaagcggctcattgtccacatccagataattgctgcggaacttttcgaaccacttgccttgtgccagcgggcgtcccgtattcttatgtgcataatacagcggaatctgaccgacattcttcgggaaactcattgtcagttttccacccggattgacatatccgaagagtgcgtcgccgatggcataagcagcttcgctgcctccgaaccatacgttcagaatagcaggtacgtgttcctgttcccaagtcagcgtcagcggacgacctgtgaataataccagtacgacaggttttccggttttaagcaactccttcagcaggttttgctgtacatccggaatattcaggtctgtacggctactgctttctccgctcatctcggaagattctccgagagccgcaatgatgatatccgactgattggctaccgtcaatgcttcgttcagcaattgctcgtctgtccggttgtcacggtttagtgaacgtccgaacatcgtggcgcgttcttcgtaagaggcgtcgctgatcagattgctccctttggcataaaggatgtttgcttttccggcagtcatctctttcaggccttctaccagtgacggacagcggtcgagtacggcagctacgctccatgtacccggcatattggtccggctgtcggccaacggacctatcacggcgatgttacctttcgggttaaaaggaagaagaggttcggcaggagttcccggacgcagggtcacgttgtcattctttaaaagaacaaagctttctgcggcaattctgcgggcagcgtctcggtgcgctttcgtaaagatatcacgtgccggacgttttaagtcgcagtacttgtagggattgtcaaacaatcccagtttatattttgcttccaggatacggcggcaggcagtattcagtgtttccatagaaactttgccttcctgaatggatttcttgagtgtgctgacaaagccttcgctcaccatatccatgtctactccggcattgatggcacgtgcggaaaccgtttgcaggtcgccgataccgtggtcgatcatttcggagattccggtatagtcggttaccacaaatccgttgaacccccactgaccacgcagtacatccgtcatcagccacttgttggcggtagcgggcacaccgtctacttcgttgaacgaagccattacactacctacaccggcttctacagccgcttcgtaaggcagcatatattcattgaacatccgctggcggctcatgtctaccgtattgtagtcacgtccgccttctcctgcgccatacagtgcaaagtgttttacgcatgccataatttcgtcattccgttgcatgttctttccctgataaccgagtaccatcgcttcggcaatcatggctccaaggaagggatcttcaccgctgccttcggaaacacgtccccaacgagggtcgcgtgagatgtccaccatcggactgaatgtccatgagataccgtcggcactggcttctatggctgcgatacgtgccgattcttctatggcggtcatatcccaggtgcaggataatcccagcgggatagggaacatggtttcgtatccgtgaatgacatccataccgaatagcaaggggatgcccagacgggattgttctaccgcctgtttctgcacatcgcgtattttttctactcctttcagattgaacaagcctcctacttcgccccgtttgattttggcggcgatgtcgctgcttttggcttgtcccgtagtgatttctccggtgacaggtaggttcaactgacctatcttttcttccaccgtcatctttttcatcaatgcgtcgatgaagcggtccatgtcttgtggcgacttctgcgctgccgcactcaggaagccggcagcgagcagcagaagtgaaaaaaatattttcttatttatcatatcgttctatcagtttgatttgaatattaattaataatccggattctgtaccagtactcctttggacttgtcaatttctgactgaggcaaaggcaataatgcgttcttatcctggtagtttactttcccggcagcgtgcaatacttccgaggcgatcccccaacgtacaagatcgtagaaacggtcgggctccagcccgagttccacgcggcgttcgtggcggatggcttcccgcaattctccctgatcgttggtcgttattttgggcagtatattcgtattggtgcctctggcacgtgcacgtaccatttccagataatccaccgcttctccggggatattcttttcgttggcagcttcggcagccatcaatactacatccgaataccggatcaggcggatattcacccaaaagcctttgttggtgtattccttacgcagtgcggggtcggtataagcttttttgttgaagtaagctcccatagccggagagacgggggattcaccataaggttcgttggtgttttccggggtgatcggttcatcgtccgttttgcggaagtagagcagggtggcgtttttacgcgggtcacctgtctcgtaggcgtctgccatcaactgggttgccatgtgccatccccagcctaagtcccactgaccggctccgcgaacgccttgcacttcgcagaattggctgccgataacgtcactctgtggaagggcggcagtggcggtacattgcagttcgaatatagaaccgccgctgttctctccgtcgtcggtgaatatttcgttatacggagttttcagattatataaacctttgttgataacgtctgtagaggctttgtacatgttgtcccagtcactgcgcatcatataggtgcgggcatgaagtgaacgggcagctccccaagtcaggcgtccggtatattcggtgctccatgtttcgggcaatgactcttccgcagttttcaggtcggtatcgatctgctcgtagattttatcggtggtagtcttcgggatgttggcttccgaggcatcgttgatcttgtaagtcaccaaaggtacttcgccaaaagctctcactagattgaagtaacaataagcacggaagaaagaagcttcccctttgttgatgatatcttcggtttctgtttgtccggcagtctctttctcggcaatggcgtcgaggatatcattacactggtagatgatggcgtaattctttccccagtatgaacctagcaaaccgttggtcggggtgtataagaagtcatcgtacatttcggctacatccgatccgtcactcggaatacttcctttctcggagtcttcggagcgtagataatggatagcaatggcgggagtaccggcggtgatgtcgaaacttcgcatcatggtatagacattgtagattttaccgttgaccagcgcattgggattatcgtcttcggtgaattgtccctgcggactccggtccagaaagtcgctgcaactgcttatcagcagagcggaagcggcaataaaggtggaaaaaagatatttatttagtttcatacaattatagatttgattcattaaagttatattccgcatggaaacctggctgtggcaccttgccacccgcatggaaacttgggtgtggtaccttgccacgccactagaaggtcaggttgatgccgaaagtgtagacagcaggtacggggtagctgccgtcgtctactccgaaggtggtggcgctacctcccagttccggtgtgtagccggtgttgtgcttccatgtcttcaggttctgtatgttgacatagactttcagtgcctgcaagcgtattttggcaaggagggccttgtcgaacgagtaagcaagttgcacgttacggatacggaagaagctgccgtcttcgatgtaatactccgaattcaggttgttgatagaatgtttggagttcagcaacggctggctgttggaggtaccttctccgtgccagcggtccatgcgctgtgacagatagttgaactgtgcaaagttataattgtcccaggtacggaaaatttcgttaccgtgctgtcccatcatatcgatgcccaatgaccagttcttgtagtttactccgagagaaagaccataggtgaaatccggtgtcgggttacctatcattgtacggtcttccggggtaatcttaccgtctctgttcacgtcggcgaatttcagatcaccgggagtgactgtggcaagggtattttcgggtgatgcatcgatgtcggcttgcgactggtatacgcctgccaccttgtaaccgtagaagaaaccgataggatagcccgccatcgtgtaactctgctgtttgtctccggcgatgatggagtatccgtcctgaacgaggctcttcaccttattcttgatggtggtcaggttggcgctgacagagtatccccagtcaccgatctggtcacgccagctggctgccatttcaacacccatgttttcgatttctcccaagttgccgatgccgggtactgttccggagataccgggcacttcggcaagcaagtctttggtcctcttcttataatatactccttcgaagtgcagacggttgcgcagcacgttcgtttcgaaacctgcttcccaagcttctactttttcccaacgcagattgggattgggcagataggagagctggtaaccgggatagataatggacggcttgccgaaaacagccgagtaagcatttgacaacagcggttcggcgggataggccctgtccagattctgattgcctaatgtaccgtaagatgctttgattttcaacatatcgagccatttgatatccttcatgaactcttcttcggtcatcaaccaaccgccgcctagtgagaagaagttctgccactcattgccggtgtatgagaaggcggaagaaccatcgcgacggaacgaaccgttgaacaggtattttcctttgtagttgtagatcacacgtgccagcatggataccgtagtccgttcccattgggtacttccgttggtagctgttgctgcatcaccgatgctgacaaaccatttgtccggatcgtcaggaatcaccagaccgacaccttgcttgcgtgctccgtccagtcggctcagtgaattgtaatacgtcgtgaaaccgactgtagcggtcaggttatgattgccgtgatcaaaactattggtgtaagtcaatagatagtcactctgcactttcgtttcattttccttgaactggctgacttctgtcttgccggttcccaatgtaactacatctcctgcggcagtatcgtcatacaccttcatgacaggcagatatgtccgtccgttgttggaagcatagtccatggagaacatcgctttgaagttgaaatgtttcaggaagtccacttcgccatagatattacccgatgcccggtagttttcggctttggtcgtattggctttcagatcgacgtctaccatcggattgttgatctgtgctttctgaaattcgggcagaacactgtataagccatattccttattatataccggtgcgataggggcagcacgaagagcgccgagcacctgtttggagtctgccggaagcgtgcgtgctccgttgaactggaaaccgactttcagaaagtccgtgatcttatagtcattacttgcattgatggtcactttactgaacttctcatgcttgatgtttccctgttcgtgagagtaacctacgcccagatagaaactgtgtttcggcgaagctccggtaatactgatattattgttggtgatgaatgcagtctggaaaatctcatcctgccagttggtgttcgcgttccagccgctgaagtcgaacggagtgtccttctgattggcaagctgttcgctgtatagctcctgaaattgcggaccgttgaccaaatcaaccttatctactactttcttgaaaccgaaagaggtattaatgttaaccagtgtctgtccttctttggctttcttggtggtgatgatgatgacaccattcgcaccgcgaacaccgaagatagccagtgatgacgggtctttcaggatctccatagattcgatgtcctccggattaaggaagttgatattgtcattgaatagtccgtctaccacgtacaacggtttgtagccattgatggagtttgtaccacggatacggatttcggggtcggcaccggcacgtccggagtttacgatttgtacacctgccacttttccttgtaaggaagataatgggttcgttgcaggtttgttggcaatttcttctcctttgacgttggtaatagaacctgtcaagtctcttttcttcgcgctaccgtatccgataacgactgtctcggctagtacctgcgaatcttctttcagggtgacgttgatcacattctgtgctcctaccttgacactctgtgtagtcattcctacataggagaataccagtacgtcttctggggtgacagagattgaatacttaccgtccatatcggtgatggttccggtggaagttccttgtacgagcaccgatgcaccgatcagcggttcattggcggcatctgttaccgtaccggtcactgtctttgtttgtgcaaaggcggatacggaggtcagcaacaagcaagtgagcgccactatgctcttaaacctgatggttttcttctgaagatcttgtaaaagtctagtcctcattgcattaaatttttccattcgttactatttaggttgaagtttattctgccgtcttccggcgaaagtaacaaagtgaacaaatgaaaggcaaaaaagattagggaaagagagagaaagggcaattttaacattgtaattatgatgtgtgaaaaaattatttgtctttttgttgcttgtttgttttattctatttacatttgtaaaacgaaacgaactatgaagctacttctttcttatattatagggttgttcctgattttgtctctctctgcttgtcatgatggaggtaatgcaactactcttttacatcaggcagactcactgatgcaagagttccccgatagtgccctgtctctcctcgaatccatttctcatcctgaaaagttatccggctctgaaagagctgattatgctatatttttgacacgggcaaggactaagttgtatgttcatgagtcaagtgattcattgattcggtttgcagtagattattataaaagaagttggaataatgagcgtaagatgcaagcctattattatcggggttgtgtgtatcgagacatgcggtgtatggatttggcggtaaaagatttcttgcaagcattaaaggtaattcctaaagagagcgagtatctttatttgggggccatttatgagaatctggcgggatgttatgcggaacaaaatctttataaggatgctatgcacgcccatcataaagcgcatgaaatttatattaagcaaaagaaagatgatggtctattttatgctgttagagggatagggtatgtttttatgcttcaacatcaattggatagtgctttggtctattatcaaaaagcattggatgttgcagagaatataggggaagattattataaatctataatattgagtgaattgggaattttgcataatgaaaaaggggaatttcaaaaggctaaccaatatctttctgcatctatatcttctgcaccaactggtactaatttattttctgaatatcttcgaaaaggttgtatcttacgtaatatccatcaaatggactctgcacggtattatttgaatttgagtaaatcttctccttatatatttaaccgtggaggaagttatggagaattatataaattggagaaagaagagaaaaattatccagcagctatagcggcagctgattcttttatttattatctagattcaatttatgatacaacaaaggcagctgagataactcgtttggctgatcaatatgaaatcgaattttatcagcaaaaaattgcgggaagatataaaattgaggtcttatcacttttgctgttatttattattggaggagcgatttctctttggattgataaacgtcgaaaaaagaagtatcttgagttacaaaatcaattaatgaagagtcgtacagatattctatctggggactttgaggatcagggtaatgctgaatctgattttatgaggatgttggagccgagtttagaactttgtcttcagttgtttcgaaggacagaaacccatgagaaacttctttctttggagaaaaagatgggcgttgctacctctttgagtattcatgaaggacagatgatttgtgaaagcatttatgaaacttttggcgacattatgcttaaattgaaaattcaatatgctgatttaactaaagaagacttgctccattgcgtatttttcttattgggttgctccaaagaaacaatcttattatgtacacgtgcttctgaaggagcatttaaaagtcggaaaagtcgcatgaagattaagttaggagaagaattctttgaatggatgactatacgccaatatcttgtctcataggtgtttatgttggattgtgacattcctgtaacttttctgtaacttgcagtcgagatccatagttatcttgtaactttattgtgaccaggcatctgaatttatttaaatcttatcccttacatttgtatcataaccaataaaaataagtattatgaaagcaaaactattattattactttgttgcttatttgcgattgaaggatgggcaaattcaaatgatattcatttactaaaagatagccgctctaatcctatgggaatacctattcaacctacttatgagaaatgtgctattctctctaatattcttaatgtaagcttcggtagagcaaaagattatgctatcattactgtaacgaataaagctacaggtgaaattgtacattccaaaacttatcacaacactagcattgtcatgattgatatgtcttcttgtgaaaaaggagaatatactattcatataattttgaatgattgtttgttggaaggtacatttactgtacagtgaaactgaactgaataaggtaatggataaatgtacttttagtcttagtgacaagaagtaactttttgtgttccttttctgtatagtcgatatttctaattgtaaaatattaagttagaggaaggaggtaatttcctttgggatctgttatttattattgttgtaacgtatttatcaacctttaaattcaatcggttatgaaagcaattttttttatgtttttattatgttgtatttgctgcttatcatgttcggatgagcaaaatactctttcagaagaacagaatgttattgagaataagacttttgaaaaagtgagtagtttagaattgaaacaacaactactggattacttgaataattcggtaaaaacaagaactacttttaataatgctgaaatgaattacgatttaggtatgcaagaaattttgcgtccacaaatccaaacctttggggaggaaatgatagttgtacgaagtaaaatggatgctaataatataatggcattttataaagagaatggtgttattgaaaactgtcttataattgaatgtgcacaaaatgctgaagatgcacttgaagaaactatgttcacatgttatgatagtaacaatattcctatttttaaagcaatggttaataaaagaaataatacatgtaatgttcttgaaatatatgatggacttgacggtctgacagcccgtggtggaaattgggggtgcaatgtatctcttggcttggctggtgctttatggtcaaccgcttttggaatggttacggctggtgcgggatttgttgtggcggttggttggtgtgtgttacaaacttggctatgtagctcccgtgtagtctctcgccctccaacggaaatacaaatagatacaatagaatttaagccgatggaaagagatgatgatagtatagcgagagacacaataggtaaactattgcccctgcgttgataattatttaatatgtacagtaaatgagaaataatatcaaattagcattgttttatattttaatattaggtctgttctccattcttttatgtacagaaaatagtatttggttttctgcttctattgcaatgatttgtacatcaacgggagtttgcataggacaacttattaagaaaagaaaacgatttcatgctagtactgacaaattatgggttctatcaggactgtttttattatctatcataatttcattatgcatttatttcttttttgataataaccccaataaagtgacatatattttactgatgaatctagttctagctttaggttctatattgtatatctatatcactagagaaaaaacataaaataattagtcgtatgaattgataattagaatatttcaattcatacgacttttcaaatatagtattatgagaaaacttattttatttttcctatttgtgttttctgttacagtaggatttgcacagagtttttccggagataaactgtttatttcggtagatggtggaaaaggtgtattgttcggtaagtcaaacttgtcaccttttggtgttaattatcgtggggaatataatggaggcttgacgtgtaatgtgaagacactctatcgaattgataaattttgggttgccggattaaagtttaatctctccggtacttctgccaattatacacttgatgatgaaacgaatgtagctgacaatgtagaactttggtatttaggaccgcaacttggattcaaaattccaataaccgaaagaactttaattagttgcgtattgggagccggatatctacattatcgggatgaaggtcgaagtaatagtgaatttaaatgtacttccggtgcattggccgggaatatggactttctggtagaatataaattgacagaccaccttgcggtaaacggaggcttttctgttttaagtggagactttaagaagattgaaatgacagccgatgagaaaaaggaaacactacgtccaaacaaattggatagactctatatgagacgtcttgattttcagttaggactagttttctgctattgaacatcttaggtcaaaagattagctggatagagtgaaccttgaaagatatttattacttttgaggtaaagcttggtttagctgaaaggtatacgaacagtctgaataataaataaaaatagaacaatgaaattcatgaaaaaaaataggccagatgtgatgattattatactgcttattctttggggaatatatgagatattcgtagtaccctttgaatatgatactttggtatctatttttgttggctttaatttggtgtatctttttccttggtgctgtaaagaaacaagtgctgaatatttaaagataagaaatgctgccttacaatatgctttcacattaatcattgcagtactttgtgctttaaagattgtcggagttctgtgtgaacgtatgtttgatgttgatggtctgaaaatgatatttattggcgtcttctttcaaagtgtctatttcctgattgttaaatttaaacgttcgaagatacatgaaaggtaatattaaattggcattattctttgttctattattgggactctttaccattcttttatgtacggaaagtagtcgttggttctcggcttccattgcaatgattttcacaatgagtggtgtttttctagggcaacttattaagaacaggagaaaaaagtagttaataaacagagcgctgtttcatcctttttcaagataaaacagcgctctgcttattgatattaacgcctgtatggctctcttttagtacatctgctccgcagtctccatacatcgaataacatcttccttatttccacagaaaggaccggatttctcgatcttcagcgtagacatggcggcagcaaaccgacctgcttcttcgatgctcgcacccgatacccgttgatacaaatatccgatagtataagtatctccacagccggttgcatctactacttgtccgggtttataagccggaatgcgataaaaatccgtaccgtcgtaaatgagagaccccatacttcctaaagtgactaatacttctttcactccccattcgtgcagtttacgtgcggcctcatgcggatcggaaagtcctgtgagcacttccatttcgtgctcatttactttaaggaaatgaatatattgcagagcttcccgcttgtcagtccagtctaccgggtatacgtgcgtatcacgtacttcacgcaggtatccttgcgaatcgacagctatcaatcctttccgggataactccttaatcacttctaaagaaaaatcatctgctaacagcgaaccaagatgataaatttccgcctctatctcctgaagctgggaagcggtgaaaggatcggctttagccaacacacgttgtgtacggtcatccggattttctccatagatgttctcgaagtatacagagtgctggctgggtaatgcggttacgctgatgcctatcccgcgcagctggtctactactttcatttccgtagcgccgactgctgtcactaatgcataatctatgtcattgaaatggcggatagcgtgtgaacaatagaaagctgtgcctccaggcatatagactgtgctttgaggagtgactaccttatccaaagtgatatggccgatgcagcaaagttgatgtttcttcatatatgtaatcaattaaaaagcccccaagatatttcttgaaggctttctagtttatataaatgtgtgcggatgataggactcgaacctacacgcctcacggcaccagatcctaagtctggcgcggctaccaattacgccacatccgcatgcgtcgctttttgtttagcggtgcaaagataggaagattttctgatttgacaaataattaggcaacaaagttactcacttaagatttcaaaagccttttcaatcagtgtgtccctatgtttagattggtcatcctcagtcatatcgatagctatatcaggcaaaataccttcttccagcggctgcatatttttgtcgaaatgaggactggcggagaagcggatgctccatccgttcggcagttccgatgtgaaaggaagtcccgaaccgccacctgtctggtcaccgacctggatgatcttgccattgtctatgctgcgcatcagattgacgaaatcattggttgcactgtagcaacggcggttggtcagtataacgactttcttctgccagcggatgctgttggaaggttccaggtagatcggttccggttgggaaaagtcactatgtcctgttcccgttttatgctgtatgaatccggtcaggattttactattggtaaatcgggcggcaatgcgggaagaattagtcagattacctcctccgttgtcgcgtacatcgataatcagtccgttgcaggttgccagatagacaaggatttcatccagattgccatcgccgaccccggaactgaaactttcgtagcggatatatccgatattattgtcgaatattttgtacttcatccccgccgatgtatagtagtccttgctggcactgcccaggtaatactggtaaagaatatcctcccgataattccacggatacccctgataccatgcgtcgtaataagagacacgcttggcagatgaaagattgacatgaccgtctttcaggatatagagcatctcgctgagtttatcgaaaaggtcgtcattggacatacccggtacaatcagtttgctgtatttctcatgaaccgcatcccagtcaatacctttcgagtccagaaagcaataccgttcgtcaatgatcttccatagttgctcgaagtttcctacgggatcatcagcgtaatcatcttctccgatgcaccccgtctgtatcgggaggcagcagagcagtaaaagtagttgtataattctatttctcattcttaatctttcagttcttgtccataaattctccactctccacttctcctagtacgccctcaccgacggaggcagattcgctccttttttgttggaaacccgatacaggtctttcacaaatcctaccataaatacatgagagtaggtatgtgtcttgattccgttaacattggattgttgcaagtctgccagataactgaaacgcatcttggtatatcctatcggcagatcgacagaaagcatctgacggagagacggttgattgtggagagaggtaaattggataactccgctggagttgcccagtgagaagatttcgtaataagactgtccgtagtgcggtgagaacataagtccgatcatcggcacgttgacttgatagcggagtaccatcggatagcgcttgattttcaaatgccagatagccattcccgaagcgtccagattgacgtatgcccgggcagaagccggattgttcgaattgcggagattgtagacaaatcctccgttgacgtcaaacagtcctcctgccagtaacttgaagttctcggtgaggcggaactggtaatggaggccatagttccagttgacgagtccggagaaggtattgttgttgtctgcgcggttgtgtgtatagccgacgtctgcctgaaagaagttctgcacagaaacattcccgtcgaacaactttgtcatccggatcgtctcgcgggaaatacggaaatctattcctttatattcctgaggcgaaagataggtgtcgaacacattggtaaatccgactccgtacatggtggcacgtgttacgtagcgatgtgcttgcagactgtcggtctgcgcctgtaatcttgtgcagagggcgaacaggaggtatcctgtcagccctaagtataataagtttttcttcattggcacattgggtattttttaccgcatgtatacattagctaaaacagcttcatctgtcccgtaatctcatcgatgatgtccccttcgctcttatcgctgtccgggtccagattttccggttcttcttccggttgttccggttgttcgttagtcggttccgggaaacgggtcggttcaagttcgttgatggtatccaccgtataagtagtgatacgctttccttttgccttgaagcctttgactgcaataaattcttccgcgtcaattaccatcgcttcacggaaactatcgtgtccgccgaatatgacttccagacgaggatagtactcatcagtcagcaggatcagacgggtattcttgttgtctcccagatagttctgcttgcggttggaaccttcaaaacagaaacgtttcagatacggatagttctgctggtcggcatcataaagcgcggcagtccatatcttgttcgggtcgaacttctcgacgatgctgacattatcttcgtagtggttgctcaaatcgaaattagtggtgtagaactcgccattgttgagcactaccagaatggtgtcgtcgctttggaattctcccagatattcaccccgtccgtcgtagttgaggcgcaggatatcgcggtcgaaccagacttttcgtcctccgagggtagagcctcctttctgtttcagggtaatcttatgcaccggcagtcgggtgaggatcactccctgtgcctgacgtcccttgatgctgatttcactgaaatcacgttcgaagatgatgcgtcttacacgcgggttcggctttaatgtcactttgatgatttcggcttctccgttcgggttggcgctgaaataagtgatgcgtgagtccggcgttccttgcgtgacatcgtattcacggtcgcggaccacacctgtcacggcaaaacgtttgatatacgtcgttccttctttgccgtcccggtaagtgatattgtagatggtgcgtttgtcattcttcttgaatacattgacgtaaagaatgtttttgcccacaaacttcttgtcggctaccggagtgacgatatatttaccatcccggaagaagacgatcacgtcatcgatatccgaacagttggctacgaattcatccttcttcagtgctgttccgataaatccttcatcacggttgatgtagagtttctcgttggcctctaccactttggcggcttcgatggtgtcgaagttgcgcagttcagtgcggcgcgggaagttctttccgtatttgcttttcagcatctgataccagtttacggtatagtccacgatgtgagcgaggtgatcgtcgatttcggcgatctcttctttcatacgggcgatcagttcatcggctttgtcggtgttgaacttcaggatgcgccccatcttgatttccatcagtttgagaatatcctctttggtcacttcacggataaagctcgggtagaaaggagtcaggcggtcgtcgatatgtgcgcaggcggcgtccatgtctttggattgctcgaactctttgtccttatagattcgttcttcgataaatattttttcgagggaagcgaaatggagtgattccagtatttcccctttcttgatttccagttcctgtttcagcagtcccagtgtgttgtctgccgactttatcagtaccttgctgacggtgaggaagtgaggcttgctgtcatcaatcacacagcagttgggtgagatgcttacctcgcagtcggtaaaggcgtacagtgcgtcgatcgttttgtccgatgaagttccgggtgccaggtgtaccagtatctctacgttggcggctgtattatcgtctactttgcgtatcttgatttttcctttgtcaacagctttcaggatggagtcgatgacggtagaggtggtcttgccatacggaatctccgtgatggcgagtgtcttgttgtccagcttgttgatcttggcgcgtacttttaccgctccgccgcgttctccgtcattgtatttggctacgtcgatggaaccgcctgtctggaagtcgggatatagctggaacgattctccacgcagatagctgatggaggcgtcgcaaagttcgttgaagttgtgaggtaatatcttggatgaaagtccgacggcgataccttccactccctgtgccagcaatagcgggaacttcacggggagggtgaccggttccttgtttctgccgtcgtaagacagcttccattcggtcgtcttgggattgaatacgatgtccagcgcaaacttggaaaggcgtgcctcgatgtaacggggagctgccgcaccgtcaccggtgagtatattaccccagttaccctgacagtctatcagcaggtctttctgccccaactgtaccagtgcatcgccgatagaagcatcaccgtgcggatggaactgcatggtgtgtcccacaatatttgccactttgttataccgcccgtcgtccagacgtttcatggaatgtagaatacgtcgttgtacaggcttcaaaccgtcattgatgtggggaacggcacgttccagaatcacataagaagcatagtccagaaaccaattctggtacatgcctgttaactgatgctttacgttttcgtcccgcgcgtccgccggtttgtagtctgaatgtccttccgttatctcgttgatttcgtcactcatatatcaatcttcgctttgctttaacaacaaattttcttctatccatcaaaaaaaggaggatgtgcacgcaaaaatacgaaataaattcaatatgaggacgaaaagaactcacgttttttatgatgctgacagcttcgttcatcctttgttttcttgtgtaaacttcccgaagacttgacaaagccctttttatgttgtatatttgtagtcggctatccagctttaattaaaacctgaacaaatgaaaaaagaattgttttttgctgtatctgataggaagtatatgcctttaatttggtatgatatactgacaatataaagaacggaagtctgagaaaacagactctgtgagactcatttatcattgatgggctgcgaactcttagcgggtttgcagccttttttgttgcataaaattgaagattaacctttgaaaaggggaatttgagtttataataaactggggggacgtttataataaacgatgcaggaatttattagaaacgtttgtctggtttataaataaaaggttgaagtttttcatgggagcttggtcggggtgttgcagtatctctaccacggatgcgcttatatggtgaaatatgataacataaactctgttcgctttatgatacaaagaaggagcgtgtgtcagagtcaatagtaacaaaattctcctccttcaggaaggaggagtccccgtagggggaggtggtaggtgaatacataaactattgatattcaattgtacagtacacctaccaccccggctttcagccacccctccttcccgaaggaggggagtttagttacttttgacataccctccaacaaaactataacctaatgaaaaaacgaggaagagggggcggggttatacccgtatttcccaacctttttcgtattctctgccccagagcttgttagcttccagatcgttcagaatacgtccgcttcccggatcaatatctaaagaatgacctacacgctgtgcgatattgcctaactgtactaactgagtactgatgcaagcatctacaatgccggaattcagcttaccgcctttgcggatggcgtcaaaccagttttcgaagtgataagcatccagcttttccgatggatttagcaaattaccagtttcaaacttcaagttactttttacatctttgattactttcccttgtaagtctgttattttgtactcattgcctccactgatgaaaagggtgcctgtttctccgtagaaagcggtacctactccgtatccgtctaccggtgtgctgttgcaactacgtccttcccaagagcaggatgcttcgtcgccgaactgaaaagtaataagttgtgtatccggagtttgccagtcgtcctgaaagcgataacgtcctccgacagaatctacctttgtcggataatcaacgcccagcccccaacggaggatatcaacgaaatgagttccgttattcaatgcttcaccagtaccccagttccagaaccagtgccagttataatgaatataattgtctttaaaattgggcacccgtggtgcagggccttgccataaatcccagtccagatagtcgggtacagggaccactttgcctgtgccgatagaaggacggttgttgacataccaggacttggcatatctcactttcccgattgccccagacttaatctcttctattgctttgataacgttcggccacgaacggcgctggttgccgacttggacaatccggttatatttaagcgtcgccctgactaacatttcattctctgccggattgtggctggtcggtttctccagataaacatgctttcctgcttgcatagccataatggctgctttggcatgccagtggtcaggcgtggcaatgactaccgcctcaaaatcgtccgattccagcattttgcggatatctttttctcctttgggagtgcgtccgcttattttatgaatatctgcctgacatctttcaagtgctcttgaatcaacatcacaaaggtaagtaacttcacaacctttcatcttggcaaatccttgtgccaaggcattacctctggagtttacaccaatgactccgattcgtattttttcgttcgcacccaggatttcctgataactatttgaaccgaagccgggaataatgcttcccaaggaaagggcggccgtgcctgcaactgtttttttgataaaatctcttcttgttgtcatagtgtttatttttcctcaaagttaagccgttattaactgatatcagacttcttttccgtcaatcaatcttcaaaaaacgtaaagctgttacttcttttttcgaaggagatggcgtaacccgataatgagtatacgcggaatccatagtatgaaatagatgaaaaaactgataacgagcacataccccagttgagtgaatatttcaatccacggacgtgtatagacaaggattgcaataatattgattgcaaaagagagaagaaagcatatcagataaatgtttctttcccttttaattttttgggaggtgatgatgatatctttcataatttaaaatttcatatatggtattttatattcgtcagggaaaaggatatggcgctcttcctccattgcttgattgccaagcaggcaaagtacggtggagcaataggcttcttctaccacattttgtgctttttctccagtgatacatgattggcagaaagaagagagaatgatatcggaaccatctttgtcggctccgatcatgctcagcccgttgttgacgttaatgtctccttcaataacaaaatgtggcgtgtattccatttttgtttccggtctccaactgggtccggctgtcgggatagcagcaaatactttatccttaacctgtccgataagttgccggatgcccgatgttgaatggtcctcttccagataatagataccttttgccatttccatagtacctttgtgcccgaggatctggtcttccataccgttgaatttattggaaatcaacgattcgtaggcaatcttcgttccgtcggagtatcggtaagtcacatttacgctatcgtatacttcgcgaccgtctttccagtagacgatgtctcccataccgatgatgcttaccggcattcttttggttgcccagttgcatacttccagttggtggcaggccagttcggtcattaatccgcctgagctttctttgtacaatcgccagttgatttgatgttccagttccggtgaggggacgggacggcgccagtctgcatttctgaaccaatggcagcgcattcctaccacatctccgatgagtccggaatgaatcatttgcattcctttgatatacttctcgtcatacatacgctgcatgcagaagtagagaacctggttggtcgtttgataggcatcataaatagctttgcattcgtctaaagtccgtgccatggctttttcacagaatacgtgtttgccggctgccagggcatccagtacaatgggggcatgccagttcaacggagtagagatgattacgccgtcaatatctgccgattccaaaagcttccggtagtcagtgtatgctttggcacccggacataactctactgcttgttggaggttaggagcataattgtcacaaacggcaacaatccgggcatggggaatctccttcagattgtggatatgatactgtcccctggaacctgtacctattaaagcgatccgggctttctcgttgcggatttctttaagcttttcgggtgtgcaggaagacagccagggtgtgcttgccagcagtgcagttcctcctgcgatatatcccagacttttgatgaattgtctgagattcaaatcgactcctttttctattttgtttctcatattttatagagtatatatagttccttttatatgtttgaagttctcgttgatctgttcccgttgttggtcgtcggcaatcatccagactgtactgagtatttctgcatccagcggattgtcagataagatactcgtaacttttctttgttcgttgcaggttcctgtaagcggatttataatatgcccggtgtactgttccgtattcccggaagtggacaacgtattgtcagtaaggcagaattcgtcaagagtttgttgagtgtaaggattctgcaaactgactttccagcagtctccataaggatggtgtcctattcccataatcgaactgttgccaaaatcgacgaaagcattctctatatttccccgcaagaggatttcttgaatcttttttaaggcgtatcccttcgcgaaacctccaaaatcaagtgttacggaaaagttgctaaaagagatatggtgattgccgtgaatttgtatttgtgagaaatcgtttaatgtgatgtcgaaaagatgaagagtcttttcataataatattggcatgaccgtaggatatcttccaattccgcactgacagaaactgaattttgttgtgtatggctgtttagctttgatacttcacttgtggcatcaaatcggttcaacatcttatccaacctttctaactcgtcggtaatatgtgcccaaagcatgtttagttggggaaggttagagtgaatcatcaggatatcaagacgtgtccccataacatgaggaatgaatccatgaaacatggattcatctgcataatattttatttcacttcttaacacgtgcctgcggtctttcttatttttctttctttgccagctctacagctgtagtggtgatataatatttagatattgtattctcattttcccattccggcatatttttatcatgcaaatagccaaggaatgattctgctactttactgaagtgagcttcatgtcccagcctgtccgcctgtggaatatcaatcagataaagtccttcatttatctttttgacggataggaacggataggtagcttgcagttgtttgatggccttttgcaactggctctcaaattcggagtgatcagactctgcggctttttggatgtagagctgtttcacaaaaccactttctttgtcctgaattgttttcaatgtagccttacttcctttcttaagggaggtaaaagtgtcgccaccatcacttggaggagtgtaattccagataaccttcatacctatatgaatcccctttactgtgtaatttaggctaccattcgctaaaacttccagcacattattattgatatatttgtttaagaaggcggggaaggtgtcagcctgcgtcgattgcgaaaattcaggtaatgtaatgcgggtaggccaatgtctggctttcaatacttctatatccgactgataacggatggtttcgttggggaaacattgccagttgaccagatcgataagatgagtggttacatccgcaataccttctccttgttgctctgtgtcataataccataccggacgaatcagtggcttgcctgatacattcttaaagaaatgatgaacactttccatagaaactgacggatcattcaaagaccctttttgcaattcaccaaaaagatccggattgttcagtaatactttttcgatgatattcaggatgtcatatcgttcagtcatcaagtcgtaaaggagtaatttcctttcctttgccaattgatatgcttgaatcagtaagtcgaaatccttcttgttaatggccaaaggcttgtcggaaagcacattgtatcctgctttgatagcttccagaatatagtttgtttttttctggttgtttccggcaagcacaactacgtccccttgacggtcggaaagcatcctggaaagataatcgcccccaatatatatttcttctttccaggatgtgggattctccgcccgttgattatagctatttatgtcgttcagatattgtttgacttccgctccttcgggagcatatacccgaattgtgtcgttcactgaggccagcggattcttttgcaacagactggcatgaaaatgtcctgggtcgaggaccactatttttacgttcggattcatatctttgtcatgattgttgtctgcctgcttttgggaaaaagagcaggaagcaactattaatgagatggtcaggatcccgatgtgtctgtatgtgtacctcatgtgctatttttatttgtaggttttaattagcttctgtgcatctttcagcccttttcggtatgcctcctccatggtaacgattttgccattctgttctttgctcatattggaagctttcataaaagtgaatatctcaattgtttcttctttcgaaatcggagctactccggtcttgaaaaaagtgagtatttgatcgagcaaaactttgtaaccttcatatcctcctgctgctattgcacctttgggggtataagctgtaccgccataaatggccggaccttctttgattcccctgaaagtacctatccgcccgtctttccaacggcctaccactacatcagcatcttgggaagacatacggttgactgactcgcaaccggttcccataagagtataaagcgtttctactccgtgaatgccataaaaaccgaaatcggggtgagtcggttctaccttgtgaggagaataacagtcagctcccagaattttgccgaactctccgtttctcagcttttgattctgtggagaatatctgagtgcagaagaagaaaagataggcacattgtatttctccgccatttcgtaaatggcaatagcttgtcccaatgtcgctccaataggcttgtcgatatagcatatttttccggatttgaatacttccattgcttgttcgaggtggattctaccgtcgtttgtttcaagcatgacgcaatctaccttgtcaagcaattccgctatggaagatgtaatctccacaccgtgtttcttgacctcttctatatatccgggaattcgttcgtaactggactggatagtctttgaaccataagggtaagctgctacgacttcgaactctttgacaaacttatcgtcagagtctccgttcagtagctcggtgaaagctgtagaatgggaagtatcgagcccgataattcctattttaattacatcctgcgcatatagtctgaagctgacagacaagaaagtaaggaggataaataagatatttttcatatgtatttataagtttattcgttctgcactttcaggatccaaatataaacaagaattttcttttttgcgtaatatactggccggacatttttcggaaatttctccataaagagtgttgtatactgcattggctttatttttaaaaggcacaatgcagaacatccagtccgcttttaataaggctggaatggtaagagtcagtgctttagcaggaacaaggtcgaatgcttcaaagcatttttcattcacttgttgctggcgacatatcgggtcgagttctactactttaactaaatgggagtcgttgaaattggctacatccggatcattgaatgcaatatgaccgttttctccaattcccagacagacaatatcgacaggatgacgaagcagcaattcggaataacgtttgcattcttcttcaaggttttctgcttgtccgttcagatagtttacagtcttgaacgggactttgtcgaagatgcgctgacggagaaaatttccgaaactttgtggggcttccggatgaatgccgatgtattcatccatgtggaaagcgttgattctgctccagtcaatctgtttactgtgaataagatgacttaagaattcattttgtgaaggagctgcggcaaaaatcatattgatttcagctttctctttgagaagttcgcatattttgttagtaacttctgtcgcagcacatttccccatctgttggatagaagggaacattttgactgttaatagatcttgttgaaacaggtatgtttcattgattgtagataacatggccttttgatatagttgttgttacgttaatttgattgtcgaagatgacgatgtcggcatctttaccttcctccaaagaacccttttgggaatccacatgcagaatgcgggcgggggtaagggttatcattcggatagcatcgattaggggtatgccggctatatttatcatggttcttaccaaacgatcggcggtagctacgcttccggcaaatgccgaacggtcgggaagcttggctactccgtcttcaataataactttctgaccgttggtcaggctgcctaatatggattcaccgtccggcattcccgcacctcgcatggcatctgtgcaaagtgctgttttatcggctcccttgaacttatatacgaattgtagtaaaggtttgggcagatgaatgccgtccgcaatgatttctactgtcataccatcaatcagataagctgcctctaccacacctgcatagcgataggcatttctacgggtgatggttgacatcgctgaatataaatgagtgatatgagtataccctgcttcgtatgcttttaccacttcttcataaatggcatcggtatgtgcgatggatgggagaatgtgacagctattgagcttttcccccagttcaattgctcctgccagttccggagcaatactccatcgtacaatatcttgtgaagcttccagtattgtgttatattcgtccggatgaggcgttttcaaatgattggggtcttgggctccacactgcttaggcgagaagtagggcccttccagatgcagcccgataaattgggcaccttttttattaagacttttggctttttgataaacggcaaaggtcgtcattagctcttcgtttgtgctggtcagtgttgtaggtaccatggctgttgttccatatctggcatgagtttcggctactcccagaaaggcctctacggttccatccataaagtcatgacctccgccaccgtgaacatgtatatcgataaatcctggggagacatattgttggttggcatctatgatccggtcgtcagcttgaggaatatatgcttcggatgatacaatctgttctatcttaccattccggcaaaccattattttattggtttcgatgccggtagggagtattagttccccattgataataatcagtctttccatttttttaatttttaatgtcttacgttcagttttatctccaggagttgattttatgccctttgatggcaaagaataccagatagataaagcaaggaataagtacccagtaaccgatacgcaaactgtactggtcggcaaagtgaccatataccaaaggtaagatggcattgccgcataatcccataatcagcagagaggaaccggttttggtgaatttgcctaacccatgaatggaaagaggccatattcctgcatagatcagagcgttgggaaaacctaaagcattcagaaagaagatggaagcattggcttgatgaccgaataatgtcatatcgaagtctgcccataccactccgaatgagagagccaaacctagtaatgtacaccctatcagtgcatttttctgggaaatgtatttagggataaggatgataccaagtatatatcctatcattgtgcatcccagtgtgtaagaagggaatacttttgcttccagtaaatccatccccatagagttggcgtaattgattatagtgtcaatggctataacctgtgtacctacatgaaagaaaatggccaatgcacctaatatgaggtatggaaagtcgagaatgctttttttgtcagtatgtttattgtcctgttcatcagtggcattctgctcgtcagtatttatttccggtaatacggagtagcggataccgatacctgtcagcagtaagatgatgcccagaataatgtatgggataatgacacgttgtatcaattcattgagcatggcgttctttgttgcttcgtccagtgcaccggattcaattaatgcaaagagttcactgtcgtttgctttcagaataagggcagcgaatatgagcggggagataattcctgccactttattgcagattcccatgatgctgatacgtcgtgctgcactatctatcgggccgataatggtgacataaggattggcggctgtctgcaaaatagccaggccggtgccaatagaaaacaagccgatgaggaatatttcaaattgccgtgccagagctgccgggacaaagataaaggctcccaaagcagtcagcataaagccatacatgattccttttttaaatcctactttcttcaatagaatgcccgaaggaatggccatgacaaagtatgctatatagaaagcaaaggctacaaaataggattcaaaatgggtaagctcgcaagaaatacggaagtatggaatcagtatggaattgacccatgatacgaatccgaatatgaagaacataccggctagaatagccagagatatataataagttttttttcttgccgaaggttgattgtttcccataaattggtcttttatagtatgtatttatataattgataaaacaaaggtagtacattcgatttctttcttctctgtgaaaaacgaaaagctacattcaaaaaacgtatcttttgaagcgcctgtttgtcgaatgtccgccttcattattgtgctttggtaaagtacgtatcgtattttaagataagactgtctgctatttgaatcgggtcttcctctgaaacaatagggaaagagtctttctgtaatgtccagttgtattcaaattgcgtaatgtcctggtggaatttgtcttcgtcaaaaggtttatcttccgaaacagcagcgatgactccgtctgtgaaacgtttccaacgttcccggtagaagcttcgggtaagtccgccccagcctcgattggcatagtcattcagttgggtgtcctgttgcccccatacggtcaggatacagcgtgcattttcttcatagtaatccttttccgacacggttgcaccacagtttctggcgtcttgtaaccatttcccgatggatagagtcgcgtcacaggaaaggaggcggtctacgtcaagcaagaggttgtccatacgggtactccattctctcatgcctgttgtatctttccggttatagcaagcggtaaactgatctctatattcggagaacaagtttcctagtacttgtcttccgatattgattacgtcaaagcgaaaatcactattgttgatgttccgggcttttagtagctctttccatatttgccataagtcgttatttgcgtaatgtatgccggggtttgtattccaacttttagttcccgttagtctggggcgtgcgttcattaataccgattggccgcatgtggcatgttcggtataaattttctgatgcaaggctctccacgctttgatgatattggcatcctgatttcctcctctgcacatggaccagttggttatccattggtcggtagtgacaggataatcccatgcctggtcaaaaacaaattcgtacataagagggtttacatcaaagccttcaagagttgctcccaagccatagacattgtctcctccctccttgaagagtcgtttaatcttgaaatcaatatcattcagattgcctgctatcatcgtattgccgccaaaattacccagataacaccaaatatagggattcccgtaatatttttcagtatttcgccagatttctgtatgatcgcaatagtaatcgagtaatatcagtttgttatccggtactgcttttagaaaggaacggatacggggttgagtccatttctttttgtcatagaagaacatccaggtcatttgtaaccattgggctgctgagtctacctgatgaatcgactcgtaaatcttgcttgaaacattggctaaaaaatcctcgctccagtcaggagagtcgacttcattgaaaggatcgattccataaatatggtcagtaccatatactttggtttgttcctccagaaaacggcgctgaatgattgagtataatgagtccatcggatcaataaaatgactgcggtatttttcatcgaagccaccccactgactcatctgatagatttttgcattcggataaattgtttttaattcggctggtacatgaccggcaaatgctggtaatacaggagtcatatcaaactcacgttctctttcgagaatacgtttttgtaattcctcctgatcctttagccaggattgaggtagtggactttgccagaaatcgacattggacatccgatgccagggaagatgggctggccctgtaaagtatgagcgaacctgttcgtcgctcaaacccatgtctgtccatactttgtaccaaatggattcttgtccggtaatagcaagaggcatggtgactccgtttaatgccatccagtctatcagtcgttcccagtcctgccatttccaatagggcatagtataaccgaatgtacaatagttgagaaaaaaacgattgtcacatttggaacggatatatactggctgaggtatctccggtagtacatcaggcatttccactgtctctgaggcataccaggaaacatgggtatgacagtagtttttcagataatgattcaaaccggcagccaatgagttacgattgtttccttttatccgtattttcccttgactcgattccagtataaaacggtctgtatcaatagaatctgtcagtaactcgaatagaaacgactgggcatgccggggaaataatctttggcacatttcttttaatacaggagggcctgtttctacattgcgttggcaactgactatcaaaaatagcaggagtaagtataggtatttatgattcatagaatggcgatgattaaactgtttatactaatgtgaactccggatggggcggctgatgacaaaattgcagaactcatgatagagttgggtatcggctgcgttccctgatttttttagtgtaagtagggatgcacttccctgataataggcaaggcgttttttctcccatatgccatgtttcttgaatgcactcatatagtttttcaaacgataagcctttcctctgctattcagagcattgtcatcaaattccagttccatgtgcatatcatacgtgagtgctttctggcaggcatcttccagacgagaatcggggacggattcgttgaagaaataattaggctggaaataagcataattaaatcctagtgatttccactgattatatccatctgctccataataggggatccagttgaaactatattttagtttattcaggtagatggcaaccgcatttaaaatgtcacgggtgtcggtcgctttctcggcaagccaataaaatcccgctaattctacatgttgatagttcttttcattgaacttggcacgtacctgatcgatataccatttgcaggctttaattcggtcggcagagttggaaaagtcaagcgtctggttatcaattttcccccaatacttggttgatgaggatgcttgttccgggtgttggtagacaatgggctctggtatactgatcacaatctgacgtttctgccgtggggttcccaaaatggcagaggcctctttgactgatgcatctaatgctccgattcctgtttcagattggaagtaatagtctataagtttcgtccagtctgcttgattggctgattccagattgtaccctttggcgaacattttattagcgcctcctgtacctgtgtccataatttccaaaaagaggaagctgtcgaatagccagtgggattgattgtcggtatctacatatctgatataagaacttacacgttctttatcccatgtatagggagtgcgatgatgtcctccgccataaagtaacaccatatctgtagatgtcagtaactcggtgcggttcttttcccaatcatagaattctacgactggatcgtttatttccggatcattcccggatgggagggtagggaccgtgtggtcttcgtcttggcaagcagcaagaccactacctatacaacagagaaagagaataaatagaatacgtttcatatttgcttttattttataggtgttattttaattagggagacaccgtggtaggggatggaagtttcataactaccactgaatattcctaagtttttttgtctccataagtctctgattttgactttaccttggatgcccaactgattaagggcaaagttaaagttatatttttgttgctggatatttactgctttatcctgatcccataaaatgaagtagggatccatctggaagaagccgagtgcataggaaccatcgtataactttttataccatatttgtccgttgggaactgtgagcttagtagcaggggctaccagtgggtcctgattgactgcaatcacttccggattggtcagaagacctaacgtgaaatcgtctatggcagtcatgtcacaaccaagcaataatggggcggaaaggatggaccatagggagatatgtgcatattgttcgtcagcggttaagtccgaatcgtgggattttgcaccccatcccggtcctaatttgcctactaccaacatatccggatcgttatattttccaggtgctgatacgtatgcgcaaacatcctggaaacatccgattgccattacaatattccattggtcgttgatatcacgggttgttcgccacaaattacctccggcttccgctccccagttccatacattgggagctccgtatccgacacaatatacgatatcccgttttatctgatctaaagcgttgcgcatgacgataaatggttcttgaatcgttttctcttccgagttcttctcaatggcagcataaccgcaataatcgtatttcaaatagtctactccccacttttcccaagtttttgcatctgtcaattcgtgctgacagctgcctatatgcctgccgcaggtcgtccaacctggtgaagagtagattccgaatttcagccctaacgagtgaatgtagtcagtaagtgtcttaaagtccggaaatttttcgttagccgggagttcaccttcgggtgtacgttcatcggcttcccatccgtcatctatgttcacataagtccatccgtaggcctgaagcttttcgtgcatgattcgggcagcatcacgtaccttttggtcatcagctgcaaatcgccagcagttccagctattccagcccataggaggagtaagcataatctcgctacctattttcagtgtgatctccttttcatctgttcctttctcatttgtcgcttgtaggcggaccttaaagttaccatttgtattcgtgcttccggtgatgagtcctgttttccggtttaactttaatcctttcggaagtcctttggctttataggtcataggtcgtttgccgctaaccataattggcatgagaaaaggattgccgggacgagcgccataagtcagtgggttattgatttgtggagcgtccggactttgtggagtcaatatgtatttttctttggcaatgggcttgggccatacaggaatgggctgtacgtcaccgagagttgtgaatttgacattcagccaatcagcgcggtcgtacatcattccatctccgcattcctctaccaataataaaactttgtctattcctgataaatcgatattgaaaggtttggcaggatctccttttctcataattccgcttctccatagttctttccgatctcctaatatcttgaactgaagattacaagcaaatggggtattgtcatctgcacctgctaatccggaaagcgtcttggctttttttccgatatcaaagagcatacggctgattgcatgagttcctatgccgcgttcatagacgatgcctttcacagtcaatggcgtcatagtgactgctttgttgattcgggggagtccccaatcctgtatgtaataagaactttcgcctaactcgtccagccaaatttcttttacttcttctgcctggcatttccaactaatcgttagtataaccaataacattatctgcttaatgtactgcatagtaaattatttttttaatactttctttataaccggacaaacaaggtctgcatatctcatcattcctaagtctgtgaaatgaataccgtctactgttgcttctccatcttctccaagcatcttttcggaagaaattatgtatatattcttttcaccttttgtttttagagatttgaagacactgttgacggctttattctttttgtttatttcgatagctattttcttgtcgaacagagcatgagtgaatacggggtcctcaataaatataatcggagtgcgtggatgcttatcccgaagtatgcgatagaaggtttccatcttctcatatatctgatcggaggaagcattagggacgaagtctagtacatacactcctgcatctactgaggacattacttcggctatttcgtagtctaaaagtgcatttccactgaatcccaaattgacgatttctcgattgagacggcgggaaataatattggtatgtgccatcccaggacgattggcacagccaccttgaagaatgcttgttccataaaaaacgattggtttagtccgtactggaattgccgttcgaggtactgatatagatgcttctgcgtctattccgatggacaatgaaattactccatcataaagaggtaaatatagcatatattctcgctcgaccggttccatatttgctataattgtagcttgattcacttttccggtggggcgcccactattcacaaatctccatgctccgtctacccatgtgtatagatcgagtcctttagtaccggtaggtgtcatatgattcatcaggttattattcaaattctcccatttggtggctattgttgttgaattggagcaaaatctgattgctaatcctgcggagtttctgcttaaattccataccggtttacgagagacatgctttaatgaatccggcaatcgttcgtagcgattttctgtattctttgtggctttaccatacaatggaaacttggcagcatcataatattttaattgagcttccagatattccggcaagcacaagaatgtaatgagcaaaatgatgatatgtcttttcataataaatggttgtttataaaagcaatgcaatatacataaaaagaaacttactatgtatattgctatagcttttatgaatatccggattgggctaatttttcttgaagaatccaattgtagaaacgactgcccggtttcctccggtcatgtcattcaagtgttcgtctcctacaaccattccggtagaacctccgccatcaagattaatagctcctacacagcctaatcctttcattatttgtgccagttctgttaaagtagctccaccactggcggtaatacgtccgtcacatatgaatatgaccacttttccatcttcacgataaccgattgctgtacggtccggggttacattcgctccgaaaatgtcatacggaatgatttcatagttactgagatagtaatctgtgccctttgatgtctctgtaaaatcgaatgggatttttttgtctttcagtaatacaggacctgcacttaaagcatatttaggactccagctaattgcggtagtcggattttcattagtgacaattccatatttattttctcctttgacagatggcaaaggacggtcgaaatagaaaacattgctggaggcatccgttcctgtccaaacaacattcggcttgcctgaagcatctacgccgaatgttcctcttgtcacattatacatactgttgtattctgtatcgccagtttttagtgacccccgaacggctgaaacagagcccgatttaatggaattgataacagctattcctgtatggtttccattatagaagtatcctccattgaccaataaataacagtctccattgaatgacgcagattgcgtgtcgatggttgcgggagaagatggtatgtggacacgtacttctaccttaccggtagagagatcaccaatggcgtaccatgcatggaaattactaccatttaagttactggtggtttcgtacagttcgatttctgccggtaatgtagacttggtcagtttattccatgtcaattggatcgcttgtggctctgtttccaaggaaacagtcgactctgcactgtaataagtaccggtagaggttgtcaggaaggcacgtactttataggatttgccatagtcgagtaaggtattcggaatcacttgaaatacttttccgtcttcagcaacttccggtccgttttgcttttgatcattgatagtgggtgtgttttcggtactccagcataaaccatattttacgttggtttgtccagctatgtttgtcacttgataagaggaactgatacaagttgagtttgctttgatacttcctatgattgcgatgcttggctcgtcaccgagggctaccaaccgatagagctcgtaaatggcacgtgaagtattcgtagccgagaatgctcttactccgaaatagtatatgtttccttcttccagaccattttcgattgtatattctgtgacatttgcggataccttggctatttctatattttcactggtatctgcttttcttaataagatgctgaatccggtttcattattactattgtctttccaacgtagtaatactttggtttttcccattctttctatggttatgtctgaaggtgcttgtacgcttgcagactgttcgtcgccgtcattgtcacttgagcaggctccgaaggcacatgttaataatattgctataaatataatctgtttcattttactgtactatttattgtttgattacaaagactgtttatttgctgattctgatcgcatcaagtgctttaacggttatttgttttttattaggcagtgtaaccttgtgttcttgttcactcatgtttactataaggtatacgtgttcgcctgatacactagcccattctgccgctaatactaccggagttatttcatagttgggtatctcttgcgttgggttatcaccagttggaattatttcctgtataaaacggcctcccaagaataaatcatgttgttgacggcggaaatctgtcagatttttcagaaatttagcttcccttttcgcatctgggcgcatcaacagactgggctctacccatcctaactgagaaccccataacagactacgcatactcatgaaattcaaagaaccgtctgtgatacgccaagggatgtaggtgtatccgctatagatgcaacggtcagaataaatgagcggaaacaacggaaccatttttgtatagctgttgtgcggagaattgacaactaacatcatgtcaaacaggtcaatatagcactctgcattttcttctgttgtcatggcttggttctctttgtatagatttgtgcgcatttcggtgagtaaactgcggtaggcaaaaggccaccagtcaccaccgccaggtgcatgtccgtggttggttgcatagcagggttcgctgttggcgcaacctatctgatccatatatacaccgttcgtttttagttcagttaatatctgtttgttgactcctttcagcacatctctccaaatataagaagctgggcaggttacagtatttaatacctttgagctatatacttctgtatataatgtaccatcagctttgcgacaagaggcatctttaccattaagcgttttatagctgtctgttgctggatcccatagacgaccgttaatatatggagtaataaatcctccaagttcctgtgtttctttaatcatttctttgaatcctgctttttcgggaaagtattccggatatttagtatcgaaacgatgattgtgccaataataccaatgcaatccgactccttttccatagtatttcatcgctttacgtactgcttccattgtttcagcatttacttctcccggccgtagccacatatcagcgtttttgatccattctgctataggacgttctgaaatagtttttgcaccccacagtgtttcgaaagtaaatggacgataccattgtactgcagcgtcctgccatcccttttgggtaaatcccatcactgtttcccaaggaatgcagaacttcttgttttgagtccaggcataggatgttgtcacattctgaataaatacaagactttttccttcacttttcattctgaatactttgccagatccccctttgtcttgtgcggcaaagtagactgtgcctcctttatgatgcatcagtactaactgcattgtgcctgtacacgaaggataacgtgattgcagttgtccttcattaccgattgtgtattcggtcccgaatccgacaggaagaattccttttgctccttccggtctgtttacagcaatacggggaaattcagattctgtaatcacccatccttccggcatttctgcttcaatgcgccattccggtagttcggcatctttacctaatgtgactaatatgcgtaccggacacgtcggtcctgcatctataaccatttgccaggtgaatattaatgttgaggcatcttgagttttttgtatctcgcctcctttatattcgccccatcggggcattaaggtcgggttctctccgttgggaccccgatagattagttgccacggatgtgttgtacttccatttacaggcaatatgttcatgccatccatgcggaattccttgaataagaattcttttccgttggcaaacactaattcaacattcttgttttttaatacaaagtttccattttcatttttagcagtcactgaggctgataaagttccaaaacattgtaaatagcataatatgctaataataccggttatcatatttctcatatacaaaagattaggatgaataatttctatttaataatttcgatgctttttctgaataattttattacttcctcttgtggaagagcggtttccaatatgagacgccctgctgcggggaggatacttttgcttcctgctgaccggataggtattcttttaccactctcattcatcaaagacagcttgtttttttctatatcaagagtgagttgccctgtaccgttcatatgccaataaatgatacaagtccttcctgctttctggaaaatgaatgcccggattggcttttcgtcatccttggttatttgacgataggggtataactgataatttccttttttatctttcatcagaagatattcttgttcgggatttttgagtaattctttctgtttgtctgtcaggacaccttgaagttttgcttcttcccacattttgataactctcaggttatcttccgtacgaggatgattctgtaactcttttaaattgccaactaatgatatgggagaattccatgcgacagctttgctgcaaatatattcatacatgtctggttgcatgcctattgtcttgtcgttgggagccaagtaattcacccatccgaaattgacagaagtaaaatctttggctatctgctctgcacatcgaagtgtatacttcttcattgccggacggatacgttccggagggaatatatcgaaagcattcccacgacttaaaatatgccatccataatgtgatttcaatgctccttctgcaaataatggagttggtttcatttcgttgtatactatcatctgagagcgggagacattataccaataaggcatcggtacatcttccgcaccatcaaaatagacaaaacgaaagcctgcttcgtggtagatttttcctaaacgttcggcaatctctttttggattcctgtattttggttgacacggataaacaggggccagtcatctacatccaatagtctgaaatgttgtcctttgtcatgtgaggctgcttttgagttaaatactccccgtacacatcccgtaaattgatatggtggttcggtggtatagttctcataagtgacaagctcgttgtcaatttgcaggagacgtcgtcctttctccatacgtacgccttccggattaccttctatagtgatgatagtacttgaatcatctaatggttccgagagaataaattcgcgtacatggttggtgcgggagtccggtatgccgttgttgatatatgggtcattcactgctactttggaataatgaatatgaatgccgggtatcatgcctgctgctttgattttattagtgatttcctgtaaatctttcattccattcggatattcttttctccattcataatgtccgcaagctttggcgaaatcaacataatagacgacaatggatttgaaaccacctttttgagcatatacaatatgttcatctatatttttagtcgtgacatcacgtagctcataataggagtactgatattctttacgttggcgactttctactcctaaaggcatatgatagtcacgttctactttatcaatacaggttagcagtttttcttttgaagtagtaatcagtgctgcaccggaattgaatagtttcacttgaaaatcaagtcctgcatacatcgtagtatattccttgtttgcaaaagcatcgatataggtggtcggatgggtgcctagcaggcatatggctgtctgttcatcccatgatacattcagccactcaccaaagttctcacgtttacgtactggtaattgtaataatgagatttcatctatttcagttttgcgttttaccccaaaatcttcgatacgataatcaatttgcttcagagtgaaacctatataataatctgtgatatttaactctatgatggcaatgtcataggtatcctgaaattctatacgtaattcatttccgttacgttcaattttattggctgggaaggtgcgtggctttgcaggaaacattaggaagttttcattatcgtaaggacggtattgggtaatagcgcataaaggtacatctgcatttgttatcagacattcctctcccgtagctttgtgtatcaggctgcgtgcttttccgtcattgctaataattagacgcatttccgcgttctctatgaccacatcattgttttctttctgttcattaggcatagctatacaaaattgtggcaacaatgtcgacacaagccagactaataaaaccggatatgtataatatattcttttcatcatttattttaaattctgaacggtttcgtctaaccgtttgatgaataaacatttaacggagtatctgaaaagtaatggtaacgactaggaaaccgtgcgattttcagcgttttgcggtgttttactatcaaataactctttcaggtgcaaagatacgacaaatctttgatatagtatccaatacaaacagtattcgccattttttgcctttcgatatatacctatttgcttatgccgttattttttgcagatttggataaaaaaggaaaggcaaaattcaggaagcattgaaattctttactttagttagtgcaaaaatcgaataatttattgtaactttgcagcggattcggtgtgcatataataccatcccaattaagataagtcgcaacatatatagtggttttcaatatgattatgaacaattgtacaatattaacaggtaaaaacaccgttaatattgcatatcataaaccttggtaatttttccacattcaaatctaattaattcgatttgaatgtcattgtctttgtaatccggcatgctatttcaggcttgtcgagagattttttgtgctataaaatcaagaaacattcaaaagataaaaggaaaaattcaaatggaaaaaatcagaaattggaaacaagatttctatacaatatgggcggggcaagctgtgtccctgataacaagtggggttcttcaaatggccatcatctggcatctgacaaatacaacagggtctgcgatggtgttgtcaatggcgaccttggttgggtttctacctcaagcggttttaggttctgcaatcggagtacttgttgaccgctggaaccggaaaatggtcatgattggtgcagatgtcatcatagcttgtgctggactggtacttaccgtaatttccctgtcagcggaactacctgtatggatagtaatgctcatcctcttcattagaagcgttggcactgcattccattcccctgcgttaagtgcggtaacacctcttttagtgcctgaagaacagttagtcaaatgtgccggctacacccagtccatccaatcggcaagtttcatcctaagtccggcaattgccgcttttctctatgcaaaatgggggttgaattctgcggttgcccttgacgtattcggagcaataattgcctgtatcactgttgcaatggttcacatcccaaaacaaccgattgaagcgctgcagcaagaaaactttttcaccgaactgcgcattggctataacgcaatacgacaaaataaagctcttttcacattgctttggataggagcaatcaatatgttcatttatatgccaatcaatgcgctatttccgctgatgagtatgaattatttcgagggaagtaccttgcatgcttccgtggtggaaattgtttttgcagttggtatgttgttgggcggacttctattgggcgcatggggaggtttcaaaaagcgcatggcaaatatcatcggctctatctttcttgtgggagtgtcattgactgtttccggcttgctaccaaccaatggttttatgatatttgcgatatgttgtacgttgatgggcttttctgccccattctataatggagtacagaccgcgctatttcaagaacagatacaacccgagtatttagggcgtgttttcggacttcttggcagcatcatgtcgtttgccatgccgcttgggttggtagtgtcgggtgcatttgcagaccaaatcggggtaaaccgttggtttttgttctcaggtatggctattctgcttctcgctataatagccttatgtcttccacaacttagaaaggtcgacaatcaaaaacaaaaatcatgatttatgaaacgtaactaaatctaaacagcaataagcctctgatagggaaatacgattatcggaggcttattgcaatctgttttaactacttatgtaattcctctacttttcctttgtggttgaattggctgtcgtatgctctgccgtagcctgtcgaactgttccctgaaccattcgcctatgggctggcggttgattacgagtgtcagtttagacttgtccgcagggtctttcaccacttgaaagcctgctctttctgtcgtaaaactccgattatgttcctccgaataaagtttgccctcgtatatcaaaggcttaccataagtcaatgtcgtggtctgcctttcattgaacccgacaaggcggcacaggctctctattctcataatttcctttgccataggaaaccatgcacacagcttttcgataatgcgtttcaaacctgatacttcatctttgtgtctgacacttttttccgccatctccttacggtgattctgctgtatttccaacaactggcggttgtgctcggtttgcatcgtgtgtatgcggttttgcagtatctcaatggtttcctcatgggtggcaacttcccgatacagggcggtgttctccctttccaaagtcttgaccttgttgctcccgaaaagagaaccgacactttcagctatgttggtcgctgcggtggtggctgcacctttcagtttctcggtctgtacctctttcttggcttgtctgagttcctgttcggtttcggttttctgctcctgtaaccgcttgttttctgcatcaagggcagcgttctttttctgtatgtcccgataatactgtgtcgtggtggtgtgccgtgcttcggaacctcgcacacctcgctgtaatccgtatttagccataacccttgcataattgtcgtggtacgcaatcaaggtctgacggttgaacaggtcatcggcacacaaacggacggtatttgctttcttgtgatacttccgtttgccgtcttcctgctctttcttggctttgcgcctttcacctgtcacgatgggaacaatggctgcatggatatgcggtgtcttctcgtccatgtgaagatgggcggcaaccacgttctccctgccgaatgtggcttgcagccattggatgctgtcgctgcaccattcgtcaagtcttccgttttcctgtatgtccatcatgtcctcatgtgttcccgacagaaccactcggactacacggacttggtcatgtgtaatcttccgcttgatgcctgccgtgttcagcctgtgggcaatcgcttcatccctgccatgaacgccatcggggtattctataagtaccctgttcagatgcgttcttgtcgggtctgcgtttttaggtatgattcttctctctatatggtcggattgtacggtgtccgatgaaccttttgctttctttatgtccaatgaaaaatatcccatgtagtttgatttttacggttattgttatgagtgtattctctgcctgtggcattggctctcagggtttccaaagggatttccctttggctcgatagggagtttttagcattaccgtgtaatgcgtgaagaaaacgccctattgagctatggtatttctgtctaaatacccttgggaaagcgaacctgttcccctctatattttcagccctttctttttcggtggctgcatcatccgccttgcggattgtacttgcttctcctcctttatcggctctgtcgattgggacaagagttttttgcacaggtactcgttcaagtcattataccctgcatagtgaaccgacatatcctgcaagcggtcacccaacatccgttgcaggttggcgtatgcgttccgtcctgctgtgtcattgtcaaggaaacagccgattcgggtataggttgccaatatgctttccgctttcgagaggttggaaacggagttgagaatgacgtaatcctgtgcattcaatcgtgggtgttgcggattgttctttactcggatggtcaggaacgagagataatccatgaagccctcgaaaagataacagacggttcgtggctctttttgctgtcggatatgggtgatgtccttcggggcgacacatcccttgaagtatctattacgcacttcataccctcttgccatattcgggaagccgatggcgaaatagggtttgtcggcattctcaaaccgcagttccttacactcccttttggcgagttcaatgtctatccccctttcttgcagataggcaatgagcgcaggtgatgacagctcgccaactcttaatacccgataagtgcggttgtcggattgctgcttgccaaaagaaaacgatgcagggcggatgtatggtgtccgttcctctatgcgcttcaacaggcaggttacatcttccgtatggtagagttccgctgccaatgcgatgatgttaccgcccttgccaagtccaaaatcgtaccatttgttgagttctgtgtttaccttgaaagatgcgtccgtttcctctctcagcggtgatttgtaccaaaagctgctgccctgttgcttgacgggcgtgtaacccaaactttgcagatagtctgcgattctgatttgtttaacttcttgtatgttcatgatattctatagatttgatgatgattgtaaaaacgttgatttgttgaatggcttatataacacatttatttacagaaagatatttgctcaacatcttctcaacaaaccactcgccaaaagagaaatcaacaatcgggtgctgttcctctctcaacttctcttttcgattgttgagattttgttgagagtgtatattgtttattgtcagcatagttatatccttattcatcaattcaacaaaaaaaagaatgatattacagggattcaagttgttccctcgtgacagaatagaaacgaccgacccgttttacaggctcataccgacactcccgattgtagttgaattggtaggtggtataggtcagtccgttgggtgcaggcgtaagtttccaacactcctgcaacacctttcggacttggtgcttctccacttttacctgcgagtgtaccagcaacagaagaatgtcgttgtagcagaacgagaatgtgtccgtgccgacactatccatgatgtcaagtatcagctcgtgcatctctatctccagtcggttacggttgctgcggattatcttctgcaaggcttcggtatgcaacagcgatggagcaaaccacatacggctttccttttcggtggatagtgttctgtgttgcaggaaatgaagaaaggcgggtatctccgctttcagcttttgcaggaagtcggtatcatcagactgcaagcggtctatcttgcgtacccaatagcgtgtttcccctgcatcaatgattacaggcaagtactcgttgttggagcatagcacgaacttggcgaaaaacgctatctcgtcacggtctttgcctttggcttccaccttgtaggaaagtgtggtgcttaggttcttcaaccgctcgctgtcctccctacggttgagcagcacctcgtccaccacgataagcagtttgccggcccagtcggaattgaattggctacggaaatcctcgttggtgttaaaggttacattgttctgaaataggagttttagaaaattcagaaatgtgcttttgcctgtgttgcgttcctctgataccaacagcaggataggcagcttttgaatggggtacaagtagagcagttgtaggtagtccatgcccaactcgtattgctccccgaagatgtgacctaccaaagattggatatgcgagaaatcgccctctttaggttggtggtctatcggttcatagaggttaaggaacttgccgaccacgggatggtagccgatgtgttcgggtacggtgcagaagccgtcatacttgggaacgctgccgatgtagtccttgccgtagtcttggcgcagggtttcgttgttccatgctatgcgtttccttacataccctccgttcagtttgggctgctccacaatcttgtaaagcgtagtccccactcggatgaattcctcctttgccatgccaccatccgatggcggtctgtggctgtcttgttgtttgttagctgacataatcaaatggttttaagtttgaaaaataccagctacaaaagtataagcatttatcggataagttgttacgcaaaacgcggcagaacggtgacaaatagcccccgaagaaaaaactttcaatggtttggaacggaagtcgggcaggacagacgaaaaaactcccaaaaaacgaatgtggggattacgcttttcgggagaaaaaattggagttcctgttgatatgtcggtcagattatatgctgacacgctggcttgattactctattcgtgactgaatgaatggattccgtcagtcgtgcaaccaattcagctacgagaagtattcggctttggctatgccgttggtgttcagcgaaaagaagatgcttgttttctcttttcgcaagtacagtctttcaagaacggcattgcgcacctgcttcgcactgtatgtgccgatacggaacgcaagggcgattatcgtttcaaggctgtaaacctccatgctgcacttgtcggacagtcggatggtatgccttatctcacactcattcagaatgccgttcttgcagagtgtctttatccctgccctgatagtcggggcggttacattgaacaactcgcaaagctcccactcactcatggcggttgcctgtatatctttcggcataactacattgccgaactcgttcattgttatgatgtttctttcctctttcattatcgtttgatttaagggttactgaatggcattgcaaatgttcttttccatatcctccagtttgtgcgacaatgtttccatatcctgactaatcttttgggctgtgatttttgcgtaaatttgggtcgtttttatgttggtatgtcccaaaagtcggctgacggtttcaatgggtactccgttggataacagcacagtggtcgctgccgaatgtcttgctacatgataggtcaagtggacttttataccgcacaacttggcaatggctttcagcttcttgttgcaagtcgtgttactcggcatggggaatactttattatctcttgtcatacccctgtacttctctattatctttcggggaacatccaacaatcggatattggattccgtgttagttttctttcttcgggtgataatccacagatttccgtcaaagaatgtttgcaggttgtcttccgtaaggttcttgacatcggaatatgccaaacctgtaaaggtggagaacagaaataaatccctgacaagctcgtgtgtcttgtcgggcatatcggtgttcatcattgtgtgtatctcctctctcgtaatataccctctgtccacgctttcgggagagttgatgtaccctgcaaagggattgaacggcagacgaccgtcattcctcgctatggaaataatgtgtttcagcacaatcatgtagccccaaatggtattggtgcggcattttttctcagtacgcaggaaatactcgaagtcgttgatgaacgagaggttcaactcttttaacggaatatcttcacgcttgtaggtatggggtaggaactcacggatgtgcttgcagacggtaacataacgtcggaatgttccttttgccctgctgtgtcccactttcttggcaaattcgctgttgtgttgttcaaacagttttagcaaggtttcctgtttgataccgatgccgagataggcatctttcaacttggcagcagtgacataaccgtccgtctgcatcaactcttgataacggcggtttatctccactctgattttgtcaacggcacggttgattctttgcgcttcggcactcttacccgaagcacggttgttcttcacgtcccacaggcgcaagggaacatccatcttgcaactgaactgcttaatctctccgtccaccgtaatgcgacacatcaaaggcaggttgccgttgggtttctcactgcctttcttcacgtagaacaataccttaaatgtacttctcataactcactttttttggttacaaaattaattcatagtgagttaccgacagatacgacacataacgccaaacgatgcaaaatttaggtttcgcaagaaatttgcatcatcgcacgggtaatgataaagtaactgaacttttgctgcgtttgtccatattctgtctcttcttggcttttgaacaagagaaaaatatagcgtaacgaacgctttttcagtctgttcgctacgctttactcaaatttgctattccgttaggtgtttattttatgtttttattaccacttatctgtgcgaaatggtctgaccggcagattgcgtgtattaatcagatttcctttcaggaaattccgaaaacagtaacgaacggcaacgggagatttgactgttggggatttgacaattactgtatgatccttctgatttaaagaggcctctgccggataaaagactttatctgaacctgcaatctcaaatccggagatattcatccaggggcttaatcctttttctgcatgggaaaaggagatttcaattgtctctccgttgattttcatgcttttataagatggatattcggattctattccctgatatccgtatgtcttattcaaggacatatatgcgaggcgttctccaatcccttttttattgtgaggatgcacttgaggagcttcgtatgtctctactaagtcgtttgttccgatcataccactattgggaatgagtgaaagcgccttttgttgagcttcccgcaataatgctcctatgtagccatcttctttatattcacaggcaaatgggactgtctcaacatagtagaaaggcaggtctccttgtttccatattgatcgccaatgttttaccatcgtagctaggcgttcggcgtatgttctgctacttcttacattactttctccttgataccagataaaaccttttattgtatatttgtgacaggggtataaaattccattatacattaacatcgattgtaaatagactggtgtcttgtcacttcctattaaagtcaggtcttcatccttgtaggtttgtagtatttccttaggtagccaaccttctactcttgagcctccccatgcacaggtgataactcctataggaatctgcaaggtccgttgtaaagttaatgcataatgataggcggctgcactaaacttcggagcattttccgtagttggttgctgccagcttccttctgcatactcctgcggagatagttttactgtcggctttatggttaccattcgtattcccggatgattgggagcatctgctatgacattattggagtcgcttatgggacaataatcaaatccgttcaaaggcattaccatatttgattgtccggcacataaccagacttctccgatcaggaggtgctgcaaagtgacagattgttctccatccgtcagtgttaatgtatattcttcgaaactggcagcaggcgttgtgatctgtaattcccaacaccccttttcgtcagcatgggttttgacttccttatttgcccatgaaggagttactacaacagtagaatttggagtcgcttttccccagattcgtacattgcttttttgctgtaagaccatattgtcactaagtagtggaggcaatttgacttttgcctccatattgatgctccacagtacaattattaaaaagtagataagaatcttcatgtagcatttctttttttagtcacggaaatccatttgtattttttctttctttttgatgacaggaccagccggttccggatggtgctgaggattacgataatcaaagtaataaatattcagcttatcaaataaggtgaatgcatcttccatacgtgacaggaacttgtcgtagtctttgactgtcggtgcggaccaagctgattctgccagtgcgcagaggcggggaaagatcatgaaatctacccgatctttagtatgcattagttccgtccatgtattggcctgtatgcctttgacatgtgagaggtcagaggctgacactccccattcggcaaaccatttgtcggggaaagcatatacatcttctattgggcagaatccgtcccagattcgtccccatttgtggtctttatattgtacgaagtcaaaataaagcggtttgcgcggacacatgatagtcgaatatcctttggtcagtgatttgcgcaggtaatcgggtttatcatgcctccaccacataatgatagtattatcttgctttacattcaagtcgagaagttcatcccaaccgactaaagttttacctagtgagtttactacatctgtcattctatgcataaagtagcgttctgcttcctttacagtttgtaacccttcgcgtttcaatagtgcttgtacatgtgggtctgtttcccatgccttgattccgtaagctacttcgtcgcctccgatatgtaaatatggagaagggaataaggcagctatttcttttagtatattagtcagataagtataagtttcttctttgccaacgttaaaagtgaattccggatgttcttccgttcctccgcctgagtattccgggtaagctttattggctgctgtggcatgtccgggcatgtctatttcgggtataatttcaatatgacgttctttggcatatgctatgatatcacggatctgctcttgtgtataatattgtgccggtgtatccggatcactatggcaaccttctcctcctatagttgccagtttagggtattgtttaatttcgattctccatccttgtgcgtctgtcagatgccaatggaagcgattcatcttataatatgccatcaggtcaaggatttgttttacccttttttcgccggaaaagtgacgtgcttcatcaagcatatatcctctccattcataacgcggggcgtcttctatcgttccacatcttagatctccgttggttaactgctgtaatagcgtttgaataccatagaaaactccagctggacttcctcctttgattaggacctgtttgggggcgataatcagctgatagccctctttgttttgcagtctattgtctaatgataagttgattcctttcgcagcttttttgccggggattactttcattttatagtttaaatcagcgagtttcttttcaaggaatgctgcttctttatataaactggcatccagatagtggattttctgacccgatttgagtttacacgtttctgcttgcatggtgacttcagcaggataggggataacccgtacctgttcttgtgcttgcaggctcatgaacaaacttagatagactattgccaaggttgtaagtaatagtttcatgtttcttggttttattagttatttaataataattataggattttctccatgtaaatcctctatggatactgtcgcagtgatggtacgggtctcattagggaacaatgaaatgaagttatcactccaaaataccggatttacgacttcttttgttttttctctttgtatcattaagtggttgaaaaaggataatttatcagagtcattcgttaaagtaagcgtgatctgatactctttttcttgtttttgaagttttaaatcttgctttaatgtaactttaggcatatttatcagccaatagaaattttgatgttgcgagtaacgccaatataagttttcagaaataagatttctgtttaagtcttctaattccagctttatataatatatggcagaaaggtcacctcgttgaggtacggtttctaattctttatattggtcggcgcccacggatatggtatctgtgtatgcccagcattctttcatcgaatagtctatgattctggctttggctataacagatttaagttcttgatgagtagcgtttatcacagaaatccggttcgtatttgcattcatttgaatatgaatgggttccattgctttctttgagaaatagtaagaagcattgggtgacagataccaatcataaatttgccagcagacatcgggccaacaagagtttagtttccagatcattatccctgttgtgatatcccacatccggtggttggctgcctcaaacatggcacgatacccttctgaacttactagctggcctttatatgcataatcctcgctactgactgggtcgctatagaaggttcggattgcattgtcgtatgcacgatagcagaagttattggtgtcccatgctccgtgttccgcccatatactgtctaatggataaatcggatttctccggtcaagtggcttatcaatggtaggtataaactttttcaaactttcgtatacaggtacggaaggcatgcctaattcgtttctgaacatttgcagataaacctcttctactttgtcgaagtagtaatcggagggtgcccagttatagtcgggagcgccatcatcggtagtaccggttggtaagtccggttttaaataaggagttagtttgtctacgtcccaactgatactggtagtcggtatgtaggggcgtgtcgtgtcgaggcttaatacggcttctttggtcggatgatacaattcttcatctaccaacacttcattaactccgaaccatgcaatgatacagggatgattacggtatcttttgaccatgtctttcacgcaagcgatagctaagtcattgttgagaggattatgctggttgtcacgtcccgggaacattcggtagcattgataaaatacatgccagttcatcagtccgtatttatcccagctatctagccaatcttcggaaggggaaggcatatcttcactgccgatcaaagtaatgttggcatttgccattaatcgtgcctggtcataaattcgtttgggtgagtcgtcgagaagtacatccggttgtatccatccccctttacagaagatgcgtttgccattgataaagaatacacgaccatattcttccccgtttttcattaattccgaagttacttcgcgaattccgaagtttaccttctcccgatcggacgatttcccattattcatgtcgaatgataaatcgagactgtgcatatattgctctccatatccgtttgggtaccataagtatgggttctgtatagataagacggaaaacttctggggagataatattatttctttactttcattggggagcattgtgacaggcagagttacgcttatcggtttcatgcttccagccagtttacgtgtgtaactcggataaactaattcgttgataaggcgaattgttgctttaactttaccgcttatcatcttatccgaatgattgtgtacagtcgctttgattgtaatgtcagcaactgttgtatctttttggggtagagtagtgataatatatgggtcttcaatagtgacctggctggttgcttccagggtgacggactgataaatacccatattccggtcacgcactacaggggcgcaatcccaaccacctgtgaattttaatgtttcatctttgaacaaatcggaagccgtaccacggttaggcccaaaggctataaattgtgttccggggttaggagttccgggatggtccacttgatatatttttatagcaatacagttctgtgtgggttggatataatcggttatatcgaatttgaagcggcggaacatgcctactacatcttcttttttccctatttgatgtccattaatccatacgtctgcacgatagttaattccattgaggttcagccatatttttttgtttttatattgcttaggcaaagtgaaggtcgtgcgataccaataaggttcctgccaaggattttttccattgcccaggtaactgtatttagctaagtccatttttttattaaactcatcagagacatcaggaattagaaagttgttcatgccgattctgggatcaggataaacgttctgtttcactaatgcattcaaaacagtagtcggtactgtggcttcataccagtcggtagcttggaatgaaggcatagatactttttccgcattttcgcttatttcggttgtactttttatttcccaattggttaatttcaactggttatctgctttgcttatcaagcaaaacaatagaaacggatagagtataagtaattttttcataacaatttattctacaaacattaaagctgctgcacccataaatccggcattatcttttaaacctgctggctttaactggatgcttgcagcagtttgcggacaaatgtactttttaaataaagataccattgaatcccaaaatatatctgatgaatgcataactgagcctccgataattacgacttccggatcaacgatattaacagtccaggaaagggcataagctaatgcctgggtaaactctttccatgcttttaatgcgttgatgtctccttcccgggctaatttactgatttcttctcctgaaatctttctttttgtaattctctgatataaatttgatattccagttcccgatacataatcttctatcattccttctttgtatggagacagccagatttctccggcacaaccggtagctccacgaataatttttctgtttaccactatagctgctcctaagcctgtgccaagagtgattcctagtattgaatttaggtttcttccggctccccatagggcttctcctaacatcattgcatttgcatcattatccagtttgaccggaagtccgaaagttgattctatttttttgtgtaaagggtaattgtgtaacgttggaaggttattgcattcgagaatgatgcctttgttgatatctaatggaccggtagaaccgatgccgatgccgattaattctgctccattggcttgttgtatcattcttcggattaatagagtcaattgctcaataatcatttcactgggttcgtgcgctaaagtccggatagattcggggataccgattatttgtccgttaatatcgacaagtccggcttttattttagtcccgccaatatcgactccaattgcaattttctttggatacacaattctcatagtttattcgattgatgttattttggcaccatgtgtaaattctcctggtattattccgcatttggttgcccatgtatttataagaagttgtacaggaactatacaggggattgtaaataactcagcattagtgcttgggatagtaatggcacataaattatcattttcaaacactaagtttgaatcggtgataaagataacttttccttcatatttaaggatatcttttactaaagatagtgattgttcgtaggtttctgattgcgagtgtgcaaatagaatggctatgaatcctttctttaccatttctaacgggccatgcctgaattcaccacctaataaagctgatgcaggcgtatgcgctgcttccatgaacatcaatgcactctggctggcagctgcaaaaactggtccccgtcctattaattgcacaaaagtggagccgtctatcagttcaatagctttcgacatccatggagtatttccattgaccatgttctcaataattttactgagtttatgccattgggtgctgtcgatttcttgattgcataacttcattgccagtaaatatgctacttgataacaggttatgaatgtttttgttgacgttttttcttcctttccagctttgcacaataggctatagcgagagaatttgactaaactgctatctttttcattacaaatagaaagaactgtgatgtttgaagataacttttctattagtttgattacttcatagctttctcctgattgcgaaatacatataatcaacgattctggactaattaatgaaatttgataatgcaataattctcctgcgttcagagcatatgccgggattttatatgaattaagtagagaagcagttgcgttagcgatgaagtaagaactgcccataccggttaacagaatatttctatatttgccggaacaccataattctgaaatttgtgacaaaacggatttcccttctacgcttttgtagaagtttgccgtctgcagaagtgcttgcggttgctcttgtatttcttggaaaaattgtaccatcggatttttttaattataatctagtgactttaataactacttagcaacagttgtgcaattattcatatgtaattgccaactgttactgagtagtttatagatgatcttaaatgatatttaaattttcatttataaattgaatctggtaatttcataagcaaatagtccctgatccgtagtcaacatatagacctgaacggcattgccatcagcacttcgaccgaatacaacatctcctgtttcatcaacgttggtaccaagtacctgtttgccagaaacgaacgaggctgaagatgtcataccagttaccgcataccccgttccggggatactgcctgttcctgttgtacttccttcacgtgaatcgaagataaagccattagccattgctgaagttccgggattattcgtgatgttggatacatataggcggtgggaccaaaccccattgcttgacagaccattttgaacgcctaacaaacatgtaccgttaaattcaacatatcctattccccggacattcttatcatatgtagcgctaccggaccaccaatgtgatgttggaagtgagaaatctatggcgcgtgcgcctgtgcctataggagtgtaattaattgcttgccggaagttggcactggcccaaatatatcctagtggagaagtatttgtcaatggaatgactttagttgcgttccacatggagactgatgctcctccgccccattctacataagcgttgccttgcattgcaccatctttgaacataaggaaaaccgcacgtggtacatttttggttgatgtggcaataattgcatcccctgaagtcagatcacctttgacgcagattgtgcgtccaagctctagttttttgactccattaatgcctacaggagcattggcgaatgtactcccattaatatttgcataaacgatgctcttaggtgcattctcgatgccgttaggccaaacccaggcacgtacgtttgggtcggtaacattggcgtctaaagtactagtgtatgccatagctactaaatgtccagcatcatcactggtaatagcatggatggagcggcctgcatcaatacctgtagtgttgacttttacatcaagtactttgccgttataacgatccattacaatcattttattgtaatcagtgctattactgataattagatagtcgtcaataacagccattgtacggttcgctccaacctcaaatccatgtgtgtcatctgtatagatttggaaaccaaataatgaagctgtatagcccactccctgaggtaatagatccgggagttccagactagtctgatagactgttttgtctgttccattttgtgcaataacggttatagtcggttggttacttaaatctataatgccggttgccggatccaatgatgatgattcgatagtagcccatggagagactgttaatgccgcagacttcaaggctgcatcaatagctgaagaggttttatagatgatgatttttcctgtaccacccgtactctcaggttcgacgatacgtattgttgcacgtgaatagtctgtcagttctactttactaatactggctaattttgatttcacataagcagccttaaatgtataagtaattttgcttccatcttctttgactaatgttgattggaaaccactgaccaaatcacgaatgccggaaatgctgggggagaattttgctcctacaggcaggctggctgaaactttcatttgtgtcaggtcaccttgtattttttccgtatctgaaatataataaggaacttgtatggtaattgtattacttgcctcgtctacgatagcactatatgtggtactttcatcagaagctaagcatccggttatggttagtcctgtaacattttcgctgcctgtccttgccagatcgtcagggtcctcgcagctcatgaaggctagcattgatattagtaccccggtaaatagatattttattttcataatttttctcttattaaataattattatttccacagttcattttgttcacagagtgtgttgtcttgaagttctgtgtatggaatagggaaaattgtatatttttcagggaataaacggtcttgtgtatcgcattctactcgtgcgtaactgaaactgccaccggcctgtgttatcttaacgccgtgcagacgtttatgatcaagtgttcttacggcgattccccaacggatcaggtcgaaatatcggtgtccttccattccaagttcacaaatacgttctttagacagatcttccagataatcactccaattattttgttgggcgagttccggcagtccgacgcggtcacggatcgttttcagatcagcataggcttttccaaactcgttttgtcgtgcatatgcttccgaacgaatcaagtaaatttcagctaaacgcatttctatccagtattgtccactcaaaatgctgctaaagttgatattggtatcatcagaagcgaacttacgaatcagataacctgttgttgatttgtgcacattatcttgtccggttgtagcaaaatccatatatccgtcatttccatctacatacaactggagagtacgtcctttccatgttgctccattataaagaatggaggcgtaaaaacgtggttcgcgattggtaaatggagcattgttgtaggaactgagattactccagtcaaaagattggtagctaccgtttactttgatatcgaaagaggaagcgtattcatcagatggagtgactgccgcacctacacttccttctgtaacaccggctgctttccagtcgtatggtggacacacgtagatgtcaaaagaatgttgcttggcgttctttccctgttggaagtaaaccggaaggattagctcactattattgactgaggtgaatattttgtagtaatcattggcagtcgttccttgcaataaactgtaattcaattttaatacttcattgcaggcatctatcgcatccccccagcgtttagcataaagggccgcacgtgctttcattccgtaagcggctcctttggtaatacgccccacattggtacctgtccagttttccggaaggtcttgtactgcctgggtgtattcgttgataatgaaatcccagcaatctgattcagatgaacgtgctttagctctttcgtcaggtccgtctacataatcttcatcagtacgcaggataactccgccatgacggagcaccagttcctggtaagcaaatgcacgtaagaaacgaacctctgctgtacgctttttcatttcatcctgatctaagttatctccataacctttgcttcggtcatagaaatattcgttgagttgacggatacgggtatacataccactccagttggagcggaagttgctcgtttcggtgacataattcgtctgataaaagaatttattcatggcacctccgttcactccataccaagagtattttaacagatctgtagctccatcgtccattaagcagtaagaatctatattgatagtagcattatcatatagcacgctatatagccctttgacgtaaaggtctacattttccagtgaggaatatgctacattctcgctgtaccagccagtaggatctacgtccagtacatcacattgtgtcaagcaaatgctagctgctatgcctataatgtatttttttatatttttcatattaactatttgttttaaaatctaacatctataccaaaactgaatgtacgttgttgtggataatatcctgttgctacatttgtactttccgggtcgatatacttgaaatcggtaaatgtcagtaggttagtcccgttagcataaactctgatgtttgacaatcccatcttgttggtccaggctttaggaagcgtatatcctaaagtcacgttcttcaaacgtaaatacgcaccatttcttttccagaaatccgattgttgggcattgtttgaatgagatacactgctgacagtcagacgaggatattccgcatttgtatgatcgggtcgccaactgttttctaccagataaagaggagcgttgtcccaatttgcataccagggtcttgtcataggggtcatatctgttgcgccatttaagtcttgccatgagtattgaagcattttatcacaaagtgccgctccttgaaactgaacagataaatcgaagcctttgtaattagcgtcagccattagtgcaaacatcatttccgggcggatgccacgtgatattttgattcggtcgttggaatcgatctttccatcgccgttaatatcggcatatttaatgtctcctactcgtggtgtattccatgatacttgaggtgaattggcaatctcttcttcactctgatacaaccctaatgcttttaatccccataattcaccgactgatgatccgagaacactttgccagggtaatgtgttatccgcctgtgttctgcttaagatacggttatgagcgtaagataagttgccattcaaactataactgaattctcctatacgattgcgatgtttcagtgcaatttcaaatccgcggttatcaaatgttcctgtattttcagaacttgggtagtgtccacctaaagaaggaggatagatattactaacactttgaagaatgtcgtatgtatatttgtagaatacatcaaactcaactcccaacaaaccgttccaggcactaagatcgaaacctaagttatatgattttgttttttcccaagtcagtcgttcatttggataagctactgtgttgctaagtgttccttgagtgttaggtgtactgccaaatactactccattattagtataagagtaggattttctgtacaagaaagcactaacgttgtcgctacctagaataccaaacgaacctctgagtttaaaatagtctattttaggaagtgcgtctttgaaaaagtcttcttccgacatcacccatcctaaagaaactgaagggaagaatccccaacggtgtcctttggcaaacttataagaaccgtcgtaacggaaagatgcttcggccaggtatttattggcgtaggcataatttagacgacctacataagcggcgtaagcacttttcccagaagaaccgctattagttgcagtttgggcatctcccaaagatatttcgggtaaatcgaataagtcgtaatccgtacgactagcattcagtgcagagctttttacctgagtttgttcgtagaggaaaagggctcctacatcatgaagtccgaatttgttgttatatgaaatagtcggacgtaatattacttgttgtgatttttggtcaccctgatataggttaccatctgccagcagatttgcactttgtacatagctgtagcttttggtggaagaatcataggcattgacagaatatgcataagcaaatgttttacttgccaggtcttgccagtcccaactgatgaacatatttgctttcaaacctttcaggaatggggctgtatattcgacatttgcggaactttctattctgactctgcgagattcctggaatcctgaatttgcagatccatagatcggattggctgcgctggttgcgcctcggtatgccgaagtaggataaccttcatactctttcggaacaaaaggtatagagtaaagcaactgatggaaaatactataggcttgttgattgccataagagtatcctcccggctgataataatctttgattaatgctgcggtatttagtgacactttaatgtctttggtcgcttgtacatcaatatttgaacggaaattgctgcgttcgtttttgttgcctttaataataccatcttgatgtaaatagccgccgctgatgaaatatctgaccttattgctgcctccgtttatagacagattgtgttggtgcataagggtagtcttatataagtcggaggtccagtctgtattttcaaatccatcggtagggtctccgttataagttgccgcaatttcttcgtcggtaaaatatggattatctacgccattattgtctagtttgcgagccagattataccattgcatatattgggttccgttcatcattttaggcagagtggtagcgtgcgatagagtcatactgcctctgtaggtgatatctgttttaccttcttgcccatgtttggttgttaccagcacaactccgttggctgccttcataccataaacggcacaagatgcagcgtcttttaggatggtaacagactccacgtcattcgggtctacttgtcccatagctcgttctactccatcaactaaaacaagtaccgtacctgaaccgctgaatgaagaataaccacggattaatatggaaacatcatccgatcctggttgtccgagtgattgttgggtaataaggccgggcaacttaccgactaatgtttgtgacatattactggcagttgttttcaacatatctttttgagataccgtggctacagatccggttaagtgagctttcttttgtgttccataacctactactacaacttcgtccaaattagcgacatcttcttttaagatgatgttgatcgtactgcgtccgttcacttttatctcttgtttgttcataccgatgtatgagaattcaagagtggcagtgttggatgcattgatagagtatctaccgtcaatatcggtagtggtacctgtggtcgtacctttgacaacgacgctgactcctggcaacggatcaccggtcacgtctgtgacgactcccctaaccatgttctgggcatagccatttgtggcatacgcaaaaagcatcgacaatgagaatagtatgattctgattgttcggaaactacttttttgcttaaagcattgttccatcataagataaaatttaattggttaataaaaaagtttttgggtattagatttattgtaattcttctagtactttccagcattgatataagcccctggggacatggaaacagcctttccatttgcctcctttaagtggcagaagtacttctccctggcggtttaagtaaccgaaccattcaggatattgagcatctttgaagtgcgtccatacatactcatgtattttctcgaaccactccatacattgtttgtcacctgtcaattggtaaccttttagtagggaaataagtgtttcaatgtgtacccaccaaagtttttggtcccattccagttgttggggagggcaacctttgcggtccataaaatagtagatgccaccatattctttgtcccatccgtagttaatcatcgtcaaggttacattttttgccttttcgattagatcagggcgattcaggcgttttcctaaatccatgataaaccacatcgcttcgatgtcgtgtccgggagtcacttgccgtccttcaaaacagtctacgagattgccgtccactcctatgttttcaacaataattcctcctagctccgggcgatagaatacttccatcacttcatggatacaagtctctattgttttttccagatactctttgtccaacaagtgttctatttcaagtgccagattacaaaggatcatcgggagggcgaaatttttcagattacgtgtgcccggatggattttgttccatttacctttcggattatctgcctttgagagaataatatcgaacgttttctttgcaatgtcagcatattcctgattgcctgtagccagactgagttgcccgaaagccattgtagcaaatgtataggaaaagatgttgtatggttctaccagaggattacctgcccgatccaaagaaaaataccaatgatagtttccatcatgtccgtatttctttagaaattcactgccttgaatagcgcaatccagccattcctgttttttctcaactttattgtaaagcattgagaataaccaaacttcgcgtccttgcagccaaataaatttatctgtatcgaatacgttgccttcacgatccagacaagtgaaatagccaccgaattcgtgatcctgagaatgctctaaccagaatggaagaacattattcagtagttcgtctttgtattggtttgctaatttttttaaatccataattgttagttttttatttaataaggtctattttaccgttccgaacgggtccagtatctttcaatctcctccagagactttccggtagtttccggtacgagtttccagacaatgagcatatacggtacacacatgatggcgaacaggaagaatgttccggctggagtaagattctggagcatccagggggttagctgtccgatcagataggtaccgatccaaagagcgaatccggcaatggacattgctaatccgcgtattttggtagggtacatctcagagagaagtacgaatatcacagcgcaaatggaaatggcgcaacaaaaaacataacacagaaagaaggctaacagaaacaggctggaaatattccaggcatttccgaagaggaaataactgccaatgagtatcaatgaaacgaccattccggataccccataatatatcagtttcttgcgtcctactttgtcaatgatgagaagtgccaggatagtggtcagtgtattcacaagtcctacaagaacctgatagaacagagaatcccctcctgaaagaccggcattctcaaaaatggaaggcccgtagtaaagaactgcattaacccccatgaactgtcccagaatagcaatacatacaccgataatgactgctttcagaatacctggtttcagaaggatagaccattctgaacgggtctcggaaacaaggacggattttgtctcgtttagctggaaatcagcctctttaaatgaattgtagatcttttccagaatataagtggctttcctttcttgtccttttactatcagccatctggggctttcgggtatgaaaaagataataataaagaatattatggctggtaatgtctccatgcctaacatacctctccacacttctgtaactactattttttctaaccaggcgataggtaagtggtttccactctctgaatatgccaataactggtagttgacaagataagctcctagaaaaccgacagttacggccagttgatacagggagaccatcctgcctctgaattgtgcgacggaaacttcggaaatgtaaagaggagatacaatagaaacaacaccaattccgatgccacctatgattctataaacaactaactggttaaagtcaatgcaaaaagcacagccgattgctgatgtagaaaacagaatggcagaaagtatcattgttcttttacgtccgatgctgtcgctcaatattccggaaaagagaacaccgacaatcgatccgatcaatgcgcatcctacataccatccttgttgcaaggtgtccaactgaaacagatgtgtcacctgagctattgtgccggatatgacagctgtgtcataaccgaacagaaagcctcctaaagcagcaacgactgaaaggaatatgatataacccagattaattgttgttttcatatagtttatttgatttcaaagtattctctgtatctgtcatataaatgtcctgcctgcagataagctgattgcggacttaaaaagtgagaaaactcaaaagtgattgctttatcatatccggcacgttttgccgcttccagtttcatgcggagtttgtcgaatttgatcggcaggaaccggatgggcatatcgcggtcgaatgtttccgcgtttgtccaacattgcattccgtatttgtctgccagtttcttgtttacagtgaaaaaagcatccagttcgtcgtagtcaatgtgtccgtcttgaaaagcacaagcgtctactacatcgtgtataccatcaaaaatttcattccattctctctcatgttgttctacggatacagcatcctcccttgtcatttttccggttcccatgactgcctttttaccatcaatccaaggggatataaaagtagggaggccattcgatacatctttgcattgtttacccatggtatgaaatgcaccgatagctcctttggtattgcggctgatttccgtgctaatataccagcctccgaaactcttatacttttcaccgtaagtattccatacttcgtcaatcacatatttattatattccacttcccacgacatatcacgtgtatcccaataatgaccggtgtcatacagcccaaaataaaacttcatgttatatttttcagccagtcgtaagtacatatctactaaatccacggaaggcatatagcatccttttcctaatagatatttggacggataagtgatgaacttgcgatatccggaacggatcataataacggtatcgataccaatccttttcatgtgctgaaagtcgagatcccattctttttctccccagttctggtgtggaatatcgtgagatatttcatctagaaaagtgcctgtgattttcagaccattattcttcggtacaattaatttgctgtccgtccttttgctcggagagagaacgaattcacttccatctttgccttcagcggccagtagtgtgggagccattagggcggaggctcccgctaatgcggctttctttaagaaatctctgcgattattcgcttccatagtttactttttttagtttctactctttttagtatatatttaacctattgaatttttaatagtttaatatttattactaactcggaatcatctgctagctttattaattcctttgagctagcacttttaatttattaattatgaatttattattgtgttatttattaattgggcgataatttatgattagttttattaatatggcattaatattgccccattcgcagatggggcattttatgttttctagtgtatatttttcataggctaatcattttagtcaagtaatttaggttacttggatgaattgatagaacaaagttaggcatccagagttgattttttgcgcaaaaaaacgaaaaagtgtattcaaaaaacgcatctttctactctttggtagatttatttgctgaatgcaagtaccatttaaaaaaatcatatataatttcgtttgattcaggggttgggtcatgattgactctgttgctcatcgcgacattattacggtatcctaagagccggttgaccgctattgtatggtttagcgctatccaccggtctgttccgtcagagtatcctccggaaacaagaaatgggcgaggtgccatcagcgtatgcaattcatgcaaatcatatccttctttgcggagcttcggataaatgcctttagcataatcatgcccatttttgctccatgtattttcccatggtggcggataatatcccaaataccagggttcccagtaattgatatatccctcttttgtttcgtcgaatacaattccggggtctccccatgccgcacaagcgaacttttcgtataggcatgaggcaaacattgcccacttcccaccataagaatgccctgtgatgcctattcttgtagaatcgacgtcctgtactttggctaatacttcccatgcatttgcggctgcataagctaatgctgaaagtggttggagagttgcattttcaatggtggggtaataaatggaatatgtctgattctctgtggtcttcgttgttcctattgataatgtgacaaatcctcttttcgtcaattgatatgcaaagtctctataaggttttccacccaatccgatagccgtttcgggttcataaaatgtagtgataacggcaggctttttgccttctttgtccggaaccagcaaataaccttcagtctgttcgttgggagtccagtagaagcggacacggtattgcatgaagttttcacggtggagagtatccagaatttcaaatgtttgtccggtaatgacaggcggccattgtcctaacaggctcatccatctgtccttgatttcagttcgtcgtctttgccagtcttcaacggttctgactgtatccccattataatataataaaggagagcgaaaattcccatatacattttcgtattctgcgggcgggcggaagtagctcgataacttattccatagatcagaggagtcattatttccgctatttttgtttccgctgcatcctgctagaaatgctgccagatgagtgatcaggatgaatagcacgattttcttttgctccataagttgttgattgactttgagagttaacatttaccgaacaaagatatgccactttagtaatgcctccggtactaaaaacgaaaagctatattcgaaaaacgaataatttattttttatctgttcgtgatttttttctcccgatattccaaaggggaacatcctttgaactttttgaaaatccgggagatattattatagtctttgaatccggcttccgttgcaatgtctgccaatgaacgatctgtagtaagaagtaaatcggccagatggttgacccggcagtttaagatatactgatagatggaagtatgcatcgcatttttgaatttcacttcaaaatttctgcgtgagagcggaatctgtgccagcaaagactctatggtcaggtcggaattgtaatgactctctatgtattttacaacttcgagaatgtaagggtcctttatattatgcttttctgtggattgccgcaattctatgcggatagggttgatgacgatattgaaggtcccttcatgttcctttttgatttgttgatgaatgagcctgcctatggaatatcctcctctttctacttccagttctatggaggagatgggaggatcggaaatattgcagatcaagtcatcattgtcgactcctaacagggagatttcttccggtatgtgtatgttacttatcttgcaggtttccgaaatgaatagtgcgtgtgagtcgtcgcagcagaacaacgctatgggtttaggaagctcttgcagccattggcttacttctattctgatttcgtcttcatgcttatcggattcgaaacaataaaagttgccgcctatccgtttaacttcctgacggaagccttcgcaacgttcgtcagaccagacaactccgtttatgccgaaataagcaaagttgtggaacatccgcttggcgaagaattgggcggccattctgcccgttcctttgtagtcgcccgtcagattggagtaagtagtgcttctatggtgataattctgcaatacaatcggaatattcagttctttcagtagattgacggtgtcattgttccattgtccgatgatggcgtcagctttccattcttttgcccatttgagaatacctttttctccatacatgccgctgtaataggatggaagccgatagaaaagccaaggtccgttttctttggaatattgtacaagtccgcggagcaattttctgtcaaattcactggaataatcgatcagcagtagtatttttatcatagtgtgtgcgggtatattaaagtttatggaaacaaatatataaatattagtttgttttctttctataatagtctaactttgttgcgaagaagatatgtatgacacccgggtctcgtgctgtacgacacccgggtgttgtgatgtctgacatccgggtgtcatacgtgctgacacccgggtgtggtacagaatgaaaatataaacgaaacaagaaaggagtataagacatggcaatcccttatgtagtaagaaagaaagcagacttgacgtccggagaaagaaaagagttatggtatggtgtaccaagtaaaatacaggatagaggcggagtacagaacaaagaacttgctcaagtggtggagctgcggggaggtttccaccgtggtcaggttgaaggcatattggtggaagtagcggatgccatccgctatttgctttctatgggacagtctgtgacgattgatgggctgggtacattccagactgctttgaccagtcctggttttgaacgtcccgaacaagtgacaccgggacaagtatcagtatctcgcgtttattttgtggcaaacagcgcacttcgtgaccgcatgaagaaaacaaagtgtatgcgcatcccttttaaatattatatgcccgaaagtatgttgactaaagagatgaagaaagcagaccaggagcaggaacaaacagaagaataagataaattaataccctccctgtcttatttatgagataaatgcctatctttgtggcactttttacgaaaaaaggtaattcaaattaatagatatagaaaagaaaatggcacaagaagacgtttttaagaaacttgtatcgcactgtaaagagtacggtttcgtatttccttcaagcgatatctacgacggactaggcgcagtatatgactacggtcagatgggcgttgaattgaaaaacaacattaaaaaatattggtgggacagcatggtgctgttgcacgaaaacattgtcggtatcgactctgccatctttatgcaccctaccatctggaaggcttccggacacgtggacgcattcaatgaccctttgattgacaataaggattctaaaaaacgttatcgtgctgacgtattgatcgaagatcagttggctaaatatgacgataaaatcaataaagaagtagcaaaagccgccaagaagtttggtgaatcattcgatgaggctcaattccgttctaccaacggacgtgtgttggaacatcaggctaagcgtgatgcacttcacactcgtttctcaaaagcactgaatgataataatctggatgaacttcgtcagatcattgttgatgaagagatcgtatgtcctatttccggtactaagaactggacggaagttcgtcagttcaacctgatgttctctacagaaatgggatcgacttcagacggtgccatgaagatttatcttcgtccggaaacggcacagggtatctttgtaaactatctgaatgtgcagaaaaccggtcgtatgaaagtacctttcggtattgcccagattggtaaggctttccgtaatgagattgttgcccgtcagttcatcttccgtatgcgtgagttcgaacagatggagatgcagttctttgtaaaaccgggaacggaactggattggttcaagaaatggaaggagattcgtctgaaatggcataaagcgctgggcttcggtgatgccagctaccgctatcacgaccacgataaattggctcactatgccaatgctgcaacagatatcgagttcctgatgccattcggtttcaaagaagtggaaggtattcactcccgtacgaacttcgacttgtctcagcatgagaaattctccggcaagagcatcaaatacttcgatccggaattgaatgaatcgtacactccgtatgtgattgaaacttctatcggtgtagaccgtatgttcctgagcatcatgagcgctgcttattgtgaagagcaactggaaaacggagaaagccgtgttgtgctgaaattgcctgctgcccttgctccggtgaaactggctgttatgccgttgatcaagaaagacggtctgcctgaaaaggcccgtgagatcatcgacgctctgaagttccatttccactgccaatatgacgaaaaagacagtatcggcaagcgttatcgtcgtcaggatgccatcggtactccgttctgcgtaacagtggatcatcagacattagaagataactgcgtgacattgcgtaatcgcgataccatgcagcaagagcgtgtagctatctctgaactgaacaatatcatcgcagacagagtgagcatcacttcattattgaaaactttacaataaaccattaacgaatgagtaaaaaaatctatttattctccttagtattactggctttggcttttgtttcttgtagcgaaaccgaagaagttggtaaatacgataattggcgtgcgcgcaatgaggcatttattgactctcttgcgaatgtttatgctacggcttctggtagaggaggcttggaacgcatagagatgttgactgctcctggtaattatatttattataaggaaatggagccaatgactgatcatgtagtaaaggcgggaaatcctaaatatactgactatgtgaaggtatattataaaggaacaaatattttaggagaatattttgatggtaactttaagggagataatccggttgtagatgggaaagatccaagtgaaggagattctcctaccaccattttccaggtcagcggggtaattaccggctggggtgaagtgcttcagagaatggaagttggtgatcgttggaaggtttatatcccttgggattatgcctatggaagtagcggtactacaggcattttggggtattcagctcttgtctttgatatcacattgcttgattttgctaatactgaagcggagttgaaataataagataaaactctctatatgtaaaaggtgctgtatctatattacgtagatacagcattttttttattattctccttaatgctactctcccttatctgcaaatgtgtcggaatcaccacttgcttgaccgtcctgtctcccttaatttgatcaatcagcagttgacacgctgtttcccccatcttataagtctgatgcgatacggcagataacttgggttccacataattggcgtgctgctcatccgtgtatccgatgatggcgatatcgtcgggaatacgaagtccgtgccttttgattacttccatggcggcaaaagccaatgtgtcattcatggcaaggatggcatcgggaggctgggggagagataataatgtttccgtagcaatctgtccttcctcataatcaattttccggcagacaactaattccttttcaatcggaatccgattatcgcgcaaggcttccagataaccgtgcttccttctttttacaatatccagatgattggcaccgccgataaaagccacccgtttacttccattgtccagcagatgctgggtagccatttgtgcggattgtgctccgtctgctattactgacgagaattgatcggtcaggcaaacacggtcgaacagaatcagcggcatattgatctctttcaatgcggcaaaatgagaaaagtcagttgtttcctgagacaggcaggcgataatcccctctacccgcatattgaccagattctctatattccttttttcatgctcgaaagactcgtgcgatgtcgtgataatgacgaaatatccgttatcgatcgccatgttctctatcccgttcagaatggaggcaaagaaatgagtgacaatatccggaacgatcactccgatgatgcgcggcgcattctttcgcagactcatagcgaaaggattgggacgataattcatctctttggccagcttcttggctttggcgcaaagttcacggctgatttccgggctgtctttcagcgctcgggatacagtagggatggatacgcctaatgcttgggcgaggtctttgagtgaagtatgtttccggttttccatctgaaggtctccaacttagatttatctgcaaagaaagcatattccctgataaatctccgcatttaaagaaatattttttacgtaaaccgttacgtagctttttcgcccctctcttgtccgttgagaagggttcaccccttacttttgtcgcatacaaaataatttaaaaccctatacgtatgcaataccatgaaatcggaaagacagggatgaaagtatcgtctctcagcttcggagcttcctctctgggaggagttttccatgatttaaaagaaaaagaaggcattcaggctgtgtttacagccatcgaggccggaatgaactttatcgatgtttccccttattacggacattataaggcagagactgttctaggcaaagcgctgaaggatattcctcgcgaccgttattatctttctacgaaagtcggacgctatggcaaagacggagtcaatacatgggactactcggcaaagcgtgcgacggagagtgtatatgaaagtatggaacgtctgaatattgacttcatcgatttgatcaatgtgcatgatattgagtttgccgacctgaatcaggtggttaatgagacattgcctgctttggtcgaactgcgtgagaaaggagtggtaggacatgtcggaatcactgacttgcagctcgaaaacttgaaatgggtgatagaccgttcgccaagcggaactattgaatctgttcttagcttctgtcactattgtctgtgcgatgataaattggctgacttccttgactatttcgaatcgaaagaaatcggtgtcatcaatgcttctcctctctcgatgggcttgctgagcgaacgtggtgttccggtctggcatccggctcccaagccattggtagatgcctgtcgcaaagcgatggagcattgtaaagcaaagaattatccgatagaaaagctcgctatgcaattctcggtgagtaatccaaagattgcgactaccctgttcagcaccactaatccggagaatgtgaagaaaaatatcggctttattgaagaaccggtcgattgggaactcgtgcgtgaagtgcgggaaattatcggagaacagcagcgtgtaagttgggcaaactcttaaaaaacgatcgattctatggattatacgattattgatgcgcatgcccatctgtggcttcgccaagatacggtggtcgatggttttcctatccgtactttagagaacggacgctccctgtttatgggggagattcggcagatggttcctccttttatgattgacggggtgaatagtgcggaagtttttctgtccaatatggattatgcccaagtctcggctgcggttattacacaagaatttatagacggcattcagaacgattatctgatggaggttgtttcacgctatccggaccgtttctttgtttgcggaatgtgtgagtttcgcaagccgggctatctggaacaggcgaaagaactgatcgggaagggatttaaagcgattaagattcctgcccagcgcttacttctgaaagagggacgggtaatgttgaactgtcctgaaatgatgcagatgttccggtggatggaagagcggggagtgatcttgtcagtcgacttggcagagggggcgatacaggttctggagatggaagagattattcaggaatgtcctcgattgaagattgctgtcggacatttcgggatggttactcttccggattggaaagagcagattaagttggcacgtcatccgaatgtgatgattgagtccggtggtatcacatggctgttcaatgacgagttttatccgtttaaaggtgccataaaggctattcgtgaagccgcagaactggttggtatggagaaactgatgtggggctcggattatccgcgcacgataacagccattacttataagatgtcttatgactttgtggtgaaatccccggaattgtcggaagcggagaaaacgttattcctgggcgggaatgcgcggaaattctacgggtttgcagaacttccggaactcccgtacattaaaaatatgtcggaatagaaaggaaacaattacaataccactaaacaatcactgtacacatgaaaaagaatacatataccattcctctcgcactggttttcagccttttcttcttgtgggcgatcagcagcaatctgcttcccacaatgatccggcagttgatgaaaacctgtgaactgaacaccttcgaggcctcttttacggagaccgcttattggctggcttactttattttccctatcccgatagctatgttcatgaagcgttatagctataaggcgggaatcatcttcgggctgttgctggcagctgtcggcggattgctgttctttcctgctgccatgctgaaagaatattgggcttatctctgcatcttcttcattatcgctaccggaatgtgttttctggagacagccgccaatccctatgtaaccgtgttgggagctcccgaaacggctccgcgccgattgaatctggcgcaatccttcaatggtctgggtgcttttatcgcagcgatgtttctgagcaagctgattctaagcggcacccattatacacgcgagacgcttcctgttgattatccgggaggctggcaggcttatatacaactggaaacggatgcgatgaaacttccttatctgatattggctctgttgcttcttgcgatagcggtcgtatttgttttctcaaaattgccgaagattggagatgaaggagcggaacctgcatccggaaagaaagaaaaactgattgatttcgatgtgctgaaacgctcgcatttacgttggggagtcatcgcgcagttcttttataatggtgggcaaacagctatcaacagtctgtttctcgtatactgctgcacttatgccggtttgccggaagatacggctaccactttctttggactgtatatgctggccttcttgctggggcgctggattggtacgggattgatggtcaagttccgtccgcagggtatgttgctggtgtatgctttgatgaatatccttttgtgtggtgtcgtgatgctatggggaggaatgatcggactgtatgcgatgctcgccatctctttctttatgtctatcatgtatcctacacagttctctttggcactgaaaggactcggaaatcagacaaagagcggttcggcctttctggtaatggcaattgtcggtaatgcctgtcttcctcagttgacagcgtacttcatgcacgttaatgaacatatttattatgtcgcttatggcataccgatgatttgttttgcgttttgtgcctattacggttggaagggctataaagtaattgattaataaatttatctcaaacaaataaaatgaaagcagttcaaattgtcaacccctccgaaatgaaggtggttgaactggaaaaaccgaccgtcggtgccggtgaagtattggtaagaatcaagtatgtcggattctgtggctccgatttaaacactttcctggggcgtaacccgatggtgaaactccctgtaataccggggcatgaagtaggagcagtgattgaagagatcggtccggatgttccggctggctttgagaaagggatgaatgtaacattgaacccatataccaattgtggtaaatgtgcttcgtgccgtaacgggcgtgtcaatgcctgcgagcataatgagacattaggcgtacaacggaatggagtgatgtgcgaatacgccgtgcttccttggacgaagattatcccggcaggtaatatctcatcccgtgactgtgctctgattgagccgatgagtgtaggatttcatgctgtttcccgtgctcaggtcatcgataatgagtatgtgatggtgattggctgtggtatgattgggattggcgctattgtacgtgctgccttgagaggagcgacggtgattgcggtcgatctggatgatgaaaaactggtactggccaaaagagtgggagcgtcttacgcagtaaactctaaaacagagaatgtacatgagcggatacaggaaatcaccgcagggtttggagctgatgtcgtgattgaagctgtcggcagtcctgtgacttatgtaatggctgtggatgaagttggctttaccggtcgtgtggtttgtattggctacgccaaaaaagaagtcgcttttcagaccaagtatttcgtccagaaagaactggatattcgtggttccagaaatgcattgcctgctgatttccgtgcggtaatcaactatatgaaagaaggtaagtgtccggtagaagaactgatctcaaagattgcaaaaccggaagatgctttggaggcaatgaaagaatgggcagctgatccgggaaaggtattccgtatcttggtagaaatgtagataatttattttacagaatcaaccgcttagcccattgtattgagaatatgaagaaagaatgatcccgttggttttaaaccaacgggtcgttcctttaaaaccaagacaccgttcctttaaaaccaacagatcttttcttttaaagaaattctagatgttttttatctgttgagaatcagtgttttacggactggccctaaacacgggtcaataaatggttatcattctttacataactgcgtggcattaaaagattgaagtataatttgtgcttttagtctttagaatgttcttctattattaaggatggaatgataattggctatgatattgaatcaatccttccatcggactttggagaatcttacctatctgaatacctgtttgtcgggcagcatcctgtagaatctctttgtaacagtaggctatcgatccgatgaagtgtaccggatattgcttgtaatcatactgcatcacattcctgcgaaagaaagctataaagctgttcataactaattggcggatagccggttcttccaaatgctgtgcgataaaaggagagagactggccaaaaaacgattgggaaagggctggcgataaacccggtcgatgatttcgggaggcgtcagatcgaactgcttcagaaactcttctttcaaggtggcaggaagttgatttttcagaatatctcctaccagcagttttccaagtacggcaccgctaccttcatctcccaaaataaatccgagaggagagatgttactgacgatctcttttccattgtaaaaacaagaattggaccccgtccccaaaatacaggcgataccagccttctggccacatagcccgtgggcggcagccagcatatccgaattagctttaatattcccgataacgggcagactgtctgcaatagcccgtcggaggacgggagctttctcgggtgtacaacctgctccgtagaagtaaactgcattgaatttcccttccggcagttgaggcagaagggaagctgtcagcttctgttggatttcttcttccgactggaagaaagggttgatccctttcgttccaagtcgcttgataactgcgccgttcagtacgacacaccagtctgttttggtagaaccactgtctgcaatgagtatcatatcttaatgtatattttctttttatatagaatgtagcctattgcccagttgagaaggacaaaaagcagggcaaatacaagcgagcctcctttatctccgaagacaggttgtaggagtgcgctgtaaatatagccatgtaaagaagtcgcttcaccttggtaggtcataggaatgactgccagcgtaatcgccagaatatctgccaatacataaataaatagcggatttactccaaacgattcgaagaaacggctccagtttttataacctttaatgtcaatgatccatacgagtaatgccagaaaactggaacccagaccgcaggttacgagtacgaaggaaggagaccatactttcttgcagataggggaaccataactcagtaagaaacctgcgaaagtaaggatagtacctatcaggaacaaacgttccagcttctcatgaatatcttttacttccatcaatagctttccggcacagaagccgattaagacgtgggcgatggctgaaatagtactaagcagtccttccggatcaagtatctgaccgccatagatatgagcttgtcctaatactgcacggtcgacgatggaaagaatatttgtttcgtcgtagacatatccattgccgagggcaaggattgcaaaataactaatgagaagtacagcaattaaataaggtatatatttatgcttcatgagtaaagcgactatggcagtaactccatatcccaaagcaagccgttgcatgactccgagaatgcgaatctggtcgatagggaagggatcgtgctggaagcagagaatggaaagccagctgatgccaattccaatcaggaaaatgatcacggtccgtttgagaatttttaaacccgcgggaacactgaaggtgaaattgtactttctcaaagagatgtacgtggagattcccataatgaacataaagaatgggaataccagatcggtaggagttaatccaatccactcggcatgtttgaggggagcatacgcatgttgccaggaaccgggcgtatttactaagatcatacccgcgatggtgatgccccgcatcacatcgagtgccaataggcgtttgttacttgttgttacattcatgactgttactttttaatgtgttaagttataagtaattcaattttatctcttttttccgaaggaactgtccagtcgattgcggatcatccatgaagcaaggatgccgggaatggtgcatacgcatacccagataaagaagttggtgtatccaagatgttcctgtatccatcctgccggcattcccggaagcatcatgccaagtgccataaaacctgttccaatggcataatgagctgttttgtgttcaccatctgcaatataaatcagataaagcatataggcagtaaagccgaagccatatcccagctgttcgatggctacacaaatggagattagcaggaggttgtccggagtagctgctgccatccagacatataaaaggtcggggaggttgatagccagcgccatgggaatgatccatttcttaaaaccgtcacgggaaacgaggaaaccgctgatgatgccgcctatcagtagggcggctacgccgatggtgccataaatgactccgacggatgcggttgataatcccaatccgccttgttcggcaccatccaataagaatggagaggctattttagcaagttgggattctcccaaccgataggtgagcaggaagaaaaacataagtcccaggtttttcttctcaaagaaagtgacgaatgtcttaaagaaatcttccagtaacttacccggtgttaaccccggtcttttgacatctgaagcagggtgggggagaataaagcgatggtatagtgtcagtccgaggaataatcctgccatcagatagaaagtgatactccaggccattggaacattgccatgcgatgtttccaaccagcctgccaacataaccaggattccctgcccgaagatattggcgaaacgatagcaagtgtttctgatgcctacgaagaaggattgttctttgttgttgaggccaagcatataaaagccgtcagccgcaatgtcatgcgtggcagaactgaatgccatcagccaaaagaatgccagagtgagttgcacatagtgtggagtcgggataaaaaaggcaataccggcgaaaccggcagcaatcaaaccctgcatggcaataatccaggaacgctttgtcttgaccagatctacgaaaggactccataatggtttgatcgtccaaggcagatataaccaggaagtataaagcgctatttctgtattcgacaatcccaggcgcttgtacatgataacggcaattgtcatcacagccacataaggcagtccttccgcaaaataaagagtcggaatccagctccacggatttcgattgtttcttggtattatgttcttggcatttcttgttgatatcatggcattagtctcagatgttattcatattgtttttcaagtctgcttccgggataatagtgagctaaaatatctttgtaataataacctcgctctcccattactgccgcaccgatctgacaaagtcctactccgtgtccccaaccggctcccgtcagtgtaaagcgggttggaacatttccctcttctcctttttccttatccacaaggaatgctgaactataaagatgggaaggcgacaatgtacgtcggatctctaattcttttccgatggtcagtgtccgtaaagtacctactatctttaatcgtatcaggcgtccggaagttcctcgctctacagggattaagtctatgatttccccgaaatcaattcccgaacgttgatggattaactcagctagttcctgttggctataactgattttccaacggtagaaatcagtcgtttcctgatcgtagttattaagaacctgactcagaatctttttatcctgcgtattacagaaagcatccggagaagttcgtatccatcggtccgcttcttcttcctgcgtcagatcgggaagctgtattgccggacctgttatttgtttctccgaatcagaagcatgggattccggtatgtaatctcgtttaccggtcagataaggatgcctcacattctcccaacaattctgaaactcttccattgcaccgccacaacatttggagaatcgcgcatcgcaaatctttccttcatacatcagcacctctccacgggtagctgaaacagcttcgatagcttgtggagtagaagcacgggtaattccctgatagcgctggcaatgatcatccgcacaaacatcaaagtgcgtatgcgcttcatgatcataccatttgataagttgagagtggagagtggaatgtggagagttggctgcgctgtccggctgtatagtagctttccatttttcattctccactctcaatttattgatcagccagcttctggaaatgactgcatgcgctttcagtagttccaaagaggcggtggcactcatttctgatgagatgacacttgtcaggtaatcttctatagagattacattgatggcggtcagtgtctctccttcgacaatgattttcaaagctccctggaagcgttgtacttctttgcgttcccaatgaaaattgatgccgatggtgacatcctttagctcaaagaagatcccggcatttggctgagggtagaatatcaattcatcgtattctttccctgaccagtatatcttttctttttgataaacagccttttgtgcccctgaaacctttgtgccgtcaggagtagtgaagctttcgggaaaagaaaattcaatttcttttcccgaaaggataccgactgtaatctgaggttcttccatttcttctttactaggatgtttgatcggtgagtgcttttaactgttcctgtgacaaactgacctccttgtaaatctgagtgatttttttagctgttatcttatccaaatcttcttctcttacaatggggaatacgccacacatctccgcaatagccgggcttatcaataagccttttttcccttgggcataataacattccggccgatgtttagaacgtaggaaaataatacagttccactgttttatttcatcgcctccagtgcggtttactgtttcgagtccataccaggcaatcacattgattaaaggttctttgtcatgataaatagaaactatcttatcgtaaagatactcaaacatttcaatgatccctcttctgtttggagatgaaatgccaatgctcgtggtgaacccgttttctagatgactatgtacgctatcttcagaactaagcatgtccgatatgaaagtcatcccaaaaggattggcaatcttttcctcttttcctgctgcctgaaagtgcatatggtcaggggcggaagctccgcattccggtccgttatataagatgaggaactcgttcatgttttcggcaaggaaaagcatatcctcaaaacggtttttgatggtttgcggggtatgttcctcttcaattatggtcagatgccggcggaaaatcggataaggattgaggcatacctcataatgtccgagtgacaaagacgtttgttctgccgggcgattgtcattgcacagaaaacaaggtctttcttgtatggactgagagtcggtctgggccattgtagagattgcccgttgtggatttgggaagaatctgactctcttggtgtcccctcctagtttgagttccagcgtcttttcttttttaagattctgttctaattccttataattcttttttgccagcttccagtcttttttctgtttttctatcatctcgttgacgagacgctgaaaactttcatcgatgctgtgcatccggattcttgcctgtaactcccaggttcggatactgtctttgtagaaattgttccggttaattttttcgatatctaatgctgcgtcagagttgccttcccaacggcggcaaagatagattacatcataaatacgaccgatcgtatattcacgagaaatactcagacctatggcataatcttctccataactggtattggggaatttgatcttgcgaaggatgggagtgtagaaggcccgtggggcacccaacccattgatacgtaaagcattgttgggaccgtcctctactgtccactctttatggtcaatgacaccgggagctatctcgttcatctgaaaatccgtcattaggtaagtccctatcaccattgcacagttctgctgatagaaggtatcgacgattttctgtaaggtatgctcatccttatacaggtcatcgctatccagttgcacggcaaatttaccgcatttctcatggtgtactcctacattccagcaacctcctataccgagatcattctcctggggaatgatatgtattagtctattgtccgcactaaattcctggagggcttcggtggtaccgtccgttgagtgattgtcgatcacaatcacattaaagggaaaagtcgtttgctggctcaaagcagaatttacggcgtcacgaatggtccggatacgattacggacaggtatgatgacagatgcttcaaactcaaaagcttctctgtccaggtttactgttcgggaagaaggtcttacataggcattgatttctttcagatgcttgatacaaactttctccatttcgatctgtacttcccgatttttaggatttacgtaatcgaattgtttttctccgcttttccgggtatctgtttctatttctgtgtaaaggaactcattgatatggatgatttgaaatagattacctagcatcagacgcatttcataaaatgcagcatattggaaaactgtttcctccagaatacttgaagcaagggtgaaaatttcggaattgaataaaagcaccgaaccgaaatcaaaatcatcccggaggcttccttgttgataatcaataacgggagcttgtttgagaactccgtcaaccagttggtaatgatctgcgtataccattgcattttctgaggagttctgtataatctgtgtcatgcgttccagtgcgtacaatcctagttttagcggggtctgtttcgtgtaaagcaaaagatagctggcatcatctgcgttgtcagcaattgttttaatcgtacttgtagagtagagaccgttaatgaggagacattcacaccccggtaagcactctttgttggtatcagcgcttagcaggtagattttgttcactaattctgaagcttgcaattcttttacagtttgtatcgtatctttcggattgccaaaaggtatgaagcaattgattttctttttcattttaatgtttttttattaaagagttgttgataggggctgctgacgatttccttttgatgagcaggcaaagccccagaaaagtaaacgcagcattcaatatcagtaactcgtagctaatttgatatccatcgaaccaggcttccgaatttctttgcaatacgtagcaaagtgcaggagaaagaatggctactaacggaatatatggatcataaacttgttttttagtaaaaatgccgaaagcgaatagtccgagaattggaccatacgtatagctggccagcgtataaatcgcatcaatcacactcgtattattcagcaaattgaatacgaagatgacgattcccatcacgaacgccatcccgatgtgcacgtgtttccgtattttgctgagtgccgcttcgtctttcttgtgcgcattcagaatatctacggtgaaagaagtcgtcagggctgtcaaggccgatccggcagcggagtacgccgaagctatcaatccgataatgaacaggataccgactattcccggaaagtaattgcctgtggcgatcattgggaacaattcatcgctcttaccaggattctcgattccctgtcgggcggtgaaagtatagagcaagacacccagcatcaggaagagcaggatcacaaagaactgtgaaatcccgcttgtaatcatattcttctgtgagtcacggaagttcttgcaactgagattccgttgcatcatatcctgatccagcccgttcatggcgataacggtaaagactcctgccaggaattgcttgaagaaatatcgcttgtcgttgacatcgtcaaaaaagaacattttggagagatcgctgtctgaaatcgttgagaccaatccgctgaaattcagatgcaggctggaagctatatagtagatacaaagtacgacggagactaccagacagaatgttttcagcacatccgtccatatcaatgatttcactcctccccggaaagtatagagccagacaatgagtactgtcagtatgacattgattataaagggaatatggaaaggctcgaagatgagtaattgcaaggtcagacatactaaaaagagccgcacggcagctccgagcattttggaaataaagaaaaaccaggctcctgtcttataggaagaagctccgaagcgattttcaagatattcatagatagaaaccagattcatccggtagaaaagcggaacgagtacgaatgcgataatgaactgtccgacgataaatcccagtaccatctgcaggtaggagaagccgctggcttgtaccatacccggtacggatacaaacgtaactccggagatagtggaaccaatcatggcaaaggcgacaatataccatgccgatttgcggttgccgacgaagaagccttcgttatccgctttatgtcctgctatataggagatagcgaaaaggatcataaagtatgctatgatagtaatagataagataattggactcatatctgttgcttaaaattcgttcgcgggtgaatatattcaaatatgcttttcctacaaattgtacaaatgtagggaatttatcaaataaatgcatccttcttatgagttttttattccgggtgtgccacctgtatcatttctcgatgagtgccagtttttgttgagagaaggaagttcaggagatatcttctctaatgaaatgcctgtagtgactgaagtgtcgtgcatccagtctatgaaacggcaggtatcaatcgtgcggggatgttcttcatcagttgccaaggcaaggtaacctccgtcgttgctcagttgcggaaatttggatatttcggttatacttttgccgtcaaccttatgctttctgatcagtgtagttgcggagtgagtaaaacaaatatatcctttgccgggaataacaaggtttgtattttcatcttcctgtttgagtattgtggtactgaatatttctcccgttgctctcattttaaacagacgcagagactttacagtgatatcctgatcagcaggattatagaattcgatgtattcggcaccgtctttggcattgtcatacatcacttcgttgaatagtaacatatttctcacattgtcaggatattccggcgattccggtgtgtcaggcttgtccggttcatccggaacgtccggtatgtcgtccggttcagtacttgttattacatcatcagacaactgtatatgatggaaagtgaaaccgtcacagcggctttttgtataaacgcagtatatgccgcagcagattgactttgtgatacttgcgtcttttatttgtttctccttcgtatattcggtttccgtttccatgcgtgtccagaaagtccagtagccgttggcgtcgcattctactttgataaataatttcggagaattatttcctttcatgagttctcttcccgaagccagtaatttggattgattcccattttgccggtaaagtgctacattgtcttttgttcctcctatctgaatgtaatagccgttcagatctccggaaagtatttccgatgaagaggctaaatagaaacgggcgtaattattggcggaaggattaaaggtgagccgtaccccgaattcccatcgggtgcttcttacagaagaagaggggatcgtgatatatgctgttcctgcatcttcctgcggatcatttaagtgtacgccttctttggtattaatcgtgaatttctcggtttctcctgtccagggaagttctgatgttgaactgtccggttcaaggctctctttttcatcctcaggcggaagcgcacaactgtataataatataatgaggaaactcagaaatgtacatgccttgcaaattttcatacggctttaaattagtgttgttatctaccgtatttgtttgtgttcaacgcagaggcaattgcggatcggataatgttcatgcttgcaaaggtacagtttcttgttgaataaatgcgaaaggttcttttttgttttctgtgaatgttagaaataaaagatacggattatacgaattaacacgatagctttatgctttcacaacgctaaaaccgtgttaatctgtgtaatccgtgcctaaaagttattattcctgttattactcaaagcgcggcatcacatacttgtccgtataagaagtgaaactgatgccgggcatataatgagtattcgaattattttccagcttctttatcagtgaataatcatccgcgttcaaagcatagtaattatcggaagacggactcgtcacccgtaccgtccagtcgaacatatttccaataatggtcagcgcgtccgtttcgggattgaatgcaggaactcctgttttcaccacatcatacgtgcggcttttcagcacatagagggcattgttgacatctgtcaggaaagcaagcgtctttttatttctgaattccgtcagataaaggtgctctaatgttaatccttccggcaaagcgatggcacgaacgtagggacgtcctttcacctgtttcagatggaacagacgacgatcggcatccaacagaagatatccttcgtcgtactccttcttcaccgtcgggtttcctacgatctcaatggccggaaagcggaaattcttcttggtcatagcttctgtaaacaagaggcttttttctgcattcacgctattggaagccatatcgataaactcgatgccttgcgaagtaatgcggaaaacatcatccggcatcttcaggtctacacgcccggacatcgactccaacagaggataaagaccgatggaaggagcgttgatatccgtaggtacgctgcggaaattgaaattctccgtctgcacgatcttcggagtgaccgctatcccgttaatcgtatccggaaaacgttcgtcggacatcaactggcggaaataaaacataggcagaatactgtcgaaagccgcttcggaatagatgtttccggcagcgtcgcgacgtacggttccttttccctcttcctgtcccatcaaggcgaaatcgccgatcacgaaactatatagagtgaaaggagtcttctccggctttacgacaaagaagttgtagcaccaaggcaactgccagagaagcaggaaggcgatggtgacatataatagtatggtactgaaacgtttcatctttatttaattcttcatttttagttcttcattcttcattatcttagtcctgctttcccgctttgaaccgtacgatggagagccaggagaaagacgcggtcagcaacgtataaaccagcagatacgggaggaatttgttataagcttccggcgtgggcgacaggaagaagattcgcagtaacagtacagcgataatgagattgatgattctgcgtttccatgccggttcgaggcagatccatgcgatgagcaggtagccggaaataccggcaagataccacgtgagggcggtcagcagtatatgattcttcagttcgtgagccagtactccgctcagatagacctccatcagaaggaagttggaagcgaagcagacaagcaacagtaccaaaccggagaacaacatattgccggtcattttcagttcgggatagggcaggtgcaaagtcagtttcagacatttgcgctgcatctcgggaacaaactgtacgatggccatcagcactccggcaatcagggggatgtattgtaacatatcgatgaatatggcatcccgctgcatcatgacttcccatacatgcgcggcgcctttcatttctatcacccggttgatgcgaagcatacagtagcctgtaaaaccgagtgtagtgactacggcaagcagaaaataccaccgtgtcttgatccattctttataaaatatagcgtacatgagacttctaatttactttttaatctttaattattttattgaatcagtatttgccggtcagaccgatgaaggcatcttccagattcacatgttcgctatgcaggtccgtatagggtactgacatggatttcagttttgcttccgcctctgtgggggggaggaaggagaatgtttccagtgtattccgcatcacggaaggatgatagaaatcatcggatgcgggcagttcgtaaccttcgggaacagtacaggtatagcggcgtccttctttcagtaattcgtcaattggcttctgaatcagtatctttccgtagtccattatgatacagtcgtctaccagtcgttccatatcctgaatgatatgcgaagtcagaaagacagtcttgccttcggaacgtgcataatcgcggagatagtctacaaacaggcggcgataaccggggtcgagaccgagggagaagtcgtctaatacaagaagctcgggattctgtgccagaatcagtccgagtgctacttgtgaacgttgtccgcaagacatacgggagatgcgctgtccggtagctactttcagtttgttcatcagttcataataagcctcttttttccattgattggggtaaaaggctgcgtagaacttctcaatctgggtgatgctcatgaattgatactgtacgtgcccttctatcagcagcccgatgttgcggcgcaatgccggagccatcgtctgtatctcttgtccgaagatacggcattctccggaacgtggtttcagatatccgctcaggatgttgatggtcgtggtcttgcccgtaccattcttgcccagtagtccgaggatgcggcctttggggactgtgaaactaagattttcgtaaatcaaccgtttgccgtagtagtgcgtcaggttgttacattctatgatttgttccattttattttatcagttattctgttcaaaagaagagaagaaaaaggatgggaatcacgattccgacaatcatttctattcctcctctgccgataatacctttgctgcctttcagcatgatgactccggaaagggtgataatgatgaggccgactgcgaaaatatccgcaaagtaagtccaccattgtccggggttgtagtgcaggcgtgccattgctccgatgagcgggcggcgggtgacagattcgtagactgcctctcccgtacggacgtttacctgcaagttggacccgcctttcaagaatactttcatgatgtccgttttcgggaaatagtgcttggtatagttaccttcctctcccaatggttgcagcagaggcagtacattttcccttttcattccctctttgcccggcagtttttcggcaatcttatattctttccgttcgatggagaagttcgggttgatggtgtcacggtgattcatcacaatgccggaaatggcataaatcaagaccattccggcaaagaaaaaggataaatcacggtgtatcagcctgctccatttacggatgctgctactccacttcatacgaattagcttccatgaaatagaaagacagatactctttgccgctgcttgcttttcggtcggctatcttcgcgcggaagtcggcgatacgggcttcgggcgtgttggctgtctcgccgcgtgctttcttctctgtgtcacagccggcttcaccggttccgtgtttttcggcagcttgcgctttgagttgtgcttcccagttttggaggtaggcttcgtcaatgcgttgttcttttagtgttccggtgacgcggacgatggagttcacacatttcgggtcgaatgctcccagtgtgccggcttctacgcggatcacttgtgtgtcgtcactgcccatcaggaagattttcttggcgccatgcttgcaggtatgtgtgcaaacgccttcgatggttacttcttttcctgcaaggttttctgcatttgcaagaagagagtcaatttctaaagcagacgaagtggtctgttctgttgttgtgtccgaggaacttttctgctgtttgtttccacaagaggttccgataacggcaaccgccagtagagcgattgcgatgcttagcttttttgttttcattgttactttttgtttttatgtagtttatattcttttttatgaacttgcaaatggcttttagttctggttctttacacaacgaactgtttgaccactaagtacactgatataactcagagacaatctgccttccggatacttcgccattgagaatgtgctcattagtccgaagaactgaatattggtcaggtcgccggtgcttgtactataaataggcttatatgcagttgaagtcatgtaataactcatactgggttttccaaaccattcggttaccgtactgttgctgctggttattgccgttgcctgatatttggggacggctgaataaccggttgacatacgtactcccgagaattgataattaaatttagcctcgttgagtgtcgggattttaccaccgtcatatgctgtgtcatagaaaagagcgtcttttccgttttccaaactattgccgtccgcatctttggtcgaattacctacaaggctgaaatattcggcgcgagtcgggatgtgccatcccttcggacagatgccctgtgctccttcaaagtcgtagcagttttccggagtaactgctttgccgctaagtgcggcatggatgtcgtagagataaccgtactgcttgatagaagttgcgtcctgcaatgcttttgcagtaagtgtaccgtcaactgtaaccaattcgtacggataccagatgtgagaatctgcagccggatcacttgacggagtatatccatccggtacatagcgtaatggttccgccatccatgttgttccgttggagagagttaccgtattgtaggtaatgccgtcgtagatgaaatatccgtcatgctcttcaaaaggaacttccggctcatctcccttgatctctccctcgtctgtccagttctcgatctcaccactgagtgtaacgatgatattatcgggtaatacacgtatattgacactgtattgtccgccttgaactaaatctgtggatacgagcttttgcatcaatgtattgttatctgaagttgttactgcaagagtgaacgcagccgtctgtgggactacaatggcacgaaaagtcttattctttgtcacttgttgtgctgtgatgtctgtggcggcggcgctctcgtttacggttgtcttcatggttgccaaattgatattggcagtaggaacagagcctttgagcactatagatgaaatatccaaattcgtttcgtttgtcacattaataaccagtttggtcagcatgtgcttgaagatcatgctgatggagttcaccgaaggaagtacgtcggatttgcttgccgccataaagtcggagattccgtagttggtggtctggtcggcatgcacggtgaatgaagtcggtacaccggttgcgctgtaaggatagtaagccacgaatgaagacttgtctgctccttcgggataccatttcagacttccggcgaaagctccgtcattgaaagtcataagctcgttggtggcatatacagtgccgtcttctttagtgacactcaatccgatctgatcctgatcttcgaaattaacctctgtggcacgtgtgataataggagtgatggtcacccggtccacagatgctactccctcgttttcctcctgctggcaagatgccagaaatgctgctgtcagcacaaataatatcccctttttcatcatttgatagttttatattatgtaaatgaataattttaaaatgtataacctaacttaatcgtctcattccaacggctcgaacctgctatatattcaaggttgaaaccgtgcgtatatccgccctgtatttcggcataaattccccgatgaaagtgatagcgtaatccgacgttcactgtcgcccgtggggcagttgcatactcattctgcagatggtaataatctgtcaggcggtatggaggatcgcccggttcggctgtcgtttcagtagtcctgctcttctccgtgaagtctcctatggataaacttgcggcagctttcacatcgaaccttccggcatgaagtacgccggatgcgtaaacccgtccacaagtcattgtctgtgacgcgacataagggtacatttgggtagtcatgcttttaaatgacgaaatctcggctccgacacgcaattctcctttaggagcgatcaactcatattcgggctgaacggataaagcctttctttcgaaaatccggttggaaccgtaaacatgggtagtcgtgattccgttggatatctcctgtcccaatacattctcgtcatttgtctggcgtgaccatgagaggttgatccgcaggaaatgttcggtactacctttggcgaaacggtatctcagatgcgatgtaatccggtgtgccggaaacttaaaccagataacctctttctctccggcggtaccggaagaatgcagatactccacatctccgtaaagcgatccccattgagcctgaactgctgctccgtgagacagttccttgatggggaatccgttgatacccgattcgctcagatggactccgcttcccgaccatgcttcgtaggcaccgtacatcagtcctttatcaaggaatgcgtaataaggtgtagcggctgttccgatctcttctgctgaaacggattcgctgtttttgctgaaaatataagagaatccgatcgcataatggtccgaatgatacatgatgccgggagcgacttttaagtccagtctgtagttggtatgccgcaagtccttgcgtttggagtaattggcagaggtgaaatcgatctttccgccgatgcgccagttggtgccggcatctgctgctatacctcccataaacgcataagtttgcaaatcctttcggccgggggtaaactccagcaggtctaccggataaaatccgggatgaatgaacatggagccgctcatatctttgccggaagtgtggtcgaatgagaacgagccgatcagagaatacttctttaagtgtgtgatggacttggctactgcaccggcactccataatttgtcggcttcgtagtagttgcggaagtcaccgtgattgttcttgccgtacagttcggcgtaggagacggtgacgctgtccatcatgattcccgttacgtttgttccggcattccatgaatttcgtcgttcgataacatcgtaagtctgtgccgagcttacggctgctatacacaacagcatacatcctatatatattcctttcatattactcatgcagggattgttgttctctttcataaaaatcggcggaagagttgttcgtatcttccagtatttcataaccggcctccttcgatgcttcctcgtctacccgacggtgcaggctgcgtccgtcatacagtgcgctttgactgacatatccggcatcgatggaaggcgaaatgcgttttttgttgctcgacgaaccgccatagtacacctctaccccgtcaatcacccagtcgagcggaatcttgatgacctgatctaccgtgctgccgggcttttgtatcacactgcctgtttgctgtacatactcctgtatcgtagtgtcctgagccttgaagatgacagtggcgggagaaaatatggagaatgtataggcattcgcctgtcccagtttgatgaccacatccagataatggtcgcggctgatctggtcgcctggagcaggatgatacatcgtattccagtaataaacattgttgtagcaggcaaaatatcccggtttgttcagattgaccgacagcgggtattgcgcggcatgatctatggcgccgttgacggcgatgactgcatctgcaccgggtgccagcgggaaggaagtgccgttaccgccgaattgccagatgcactggacgataggagcgaaatcggggaaaatggttgctccggttgcttcgtcctgcgtcacccatacgttggtggactgggagttgtaaggatcgagtgtacctaagcataaatggtcgagatactgcgtctgggaatcattgttgtgcaggataatgtatttatcagcctgataagtaccttcctgcggcagcttggtacatcctccgcaatagatttccttgataatgatggcaccggctttggagtgtgtgagcggaacgttgagtgtgatatccccgtttacgagttttaccttgtctgccagtccgttgaatatatgctggtcggctttatcactgatttgtatacggtatatgccgttggtcagggcgaattgcgctgtaccgttctggtcggttaccgtcttgtaggaattgccgcggtcgatgtcttcgatttggacggtgatgccttcccgaaggtattccgcgtattcgtccggatagacggcagtcacctgcaaggtgtgcagctggtcttcgtaaggattgcctttgtcgaggtccgtacatcctccgagtaaggatgtgacgaaaagcagtacgatatagattgactgttgtttcatatttctaaagtttaatgcggcaggttagtccataataaaagttcggggtaaagattgcactggttccggttgcgtatgatttcacatacgcccgtgagttcgtgaaattaatcgcgttgaacgacagcgaaacatgatcgcctatctccttggtaatgctgatattggcagagaaatacggatcatatccgtcggctgcgaaagtataggcattgcccgatttacgtatcagatgcgcgaagtccggattttcggcttcggcggcggtgaacggatgtacctcgttgttcaggtcgaggtaggcaaccggataaatagccgtataagaatttccgtcgtagatgctgcctcctgttttctcgttgctgttttcgctgacgttgaacgcatacgacgtaccgttatattcggagaggttctgcgaccgcttgatgagcgaggcttctagtttgcaggatatgatcagccttgctttcgggatacgggtgatcgctgtgatattggcatccagcgagtgagtgcgcttgccgttggcggttgtggatgagttgtcgccgttggcatatatacctacatattggtaggaacggttggcgagactggtgtgcgaccatccgttttggtagtaataagacaaggaattgtctatgtatttggtatatgtataggccgcatccacacggaactgcgtacggagaggagtgatctccggaaaatcgatgatcatttccgctcctctgcgggtgatgtccggtccgttatcgggagaggttgacctgacgaaagtctggtctttcacctttacgtccagcggtgtccagtaactgtcctcatcgtcccgtatatatcccatgcccgtctgattgtctacggtaatctgcggattggcggacagctcgaatccttccggcaactgtagaacattgtatgcgaacggagtataggaacttgtatatttataaggcatcttcgtacggttaaagtagcctaccagcgaaatacgggtgcgggctacattgatgtcaactcctatttcggcattctgattcttctgccagcggagtttctcgttgtgtaataaagtatatggctgactgtaatagacgtaagccgactcattgttattgtatgagactccgaaagtctgaatatcccgatactcctgtcggggatagagtacatagtacgaaggcagcttctcggtcactccccatccgccccgaatcgctatgttttcgttcagctgccatctggcgttgaaacgtggcgacagtgtgttcagcttgtcgtattgcgttccgctgatgaacagattctcccaacgcaatcccgccatcagcctcagcatggtgctgccgacagctaccgacaggctttcttccgcatacaacgaaacattgtgcatatacggataagccgagtaagaacgggggcgatatccgttgggagccagcgaaggattctgataatactctccgtcgcccacattgcctgttcctttccattgcacgcctgctttcagattgctggtaacgttcttgaaacgacggttccattcgtacttcaacgaagcggcataatccagttctttggaatcgacaatctgatcggcaaagaaatggtaaggcagtttgcctgcaatgaaataaccttcctgttcagcgtggactgccggctgttcggacgcataagaataaggtgtatgtgcatgcgacttgttatcattgtaatacaccgatgcatccagtttgaggttggtaatccatgacttgttgagcagccatgccaatgacgtgtttgcacggaaaacgttgtctctgactttggtatattctcccgtatatgcgtcgggatcatccttcgtattcattcctccgatgttaccggtcagcccgatgtcgaatcggagcactttccggaacgtattgctgtaacctgcggagaatcctctgcgggtataagaagtatagggtgaattaagcttttgagtagccttgatccattcaccgcttatgttgacgattcctttatcgttgccgaggtccagccctttggaaaaggacacctgttctgtgcggggattgatggatagcagtacattccacggagtcttccctttcttcgtatggattttgaccataccgctgttcaagtctccgtactctgccgaaggtactccggtgatgacttctaccgattcgatatcggccacagagatgctgcgggtatctattccggtcatattgccgaaagaagagttgttgccgatgcgtactccgtctacttctatcgccgttccgaaagccgcgttgcctgcggatgaacctccgtcgcgcagagagaaaatattgttgctggtcaagtccgggactttcgtctttcctcccggaagaagggcggaaatatcgcttacattcgatatctgcagatgttccagtgcgttactcccgatgttgagcgtggtgttcagttcagtcttcggagcttgtgcggtaacgattacgtcgttcagggcaagtgtattttccttcagttgtatctttaatcctttgatgctgttgttcacattcaccggaaccgttgccggaacataaccgaggaaggaaacttccaattgatacttgccttcctgtattccttgtatcgtaaattcccccttctggtcggatacagcccacaaataggtacctttgattaaaatggatgcgccgggcaacggcgaacccgtcctttcgtcggatatacgaccggaaatagaataattgttagtattggcttcaattctggaaatgatcaaagaaagaagcaagcagagcattattttaagtgtaagaaacctcatagaacaaattttgtgcaaatttcgttctatatcgttaatactacaatcgcaaataatgactattttgggagtatgcgagtacccataaataggtatttctctccatagtgatttgatagcagttttgctctcatgctctaacaaacggtctgtatccctttattcatcgtggtttccagtgtggtagcaactgtggcggcaggtatgagggcaaacggttgctctcacttgcatcatggacttaatctcgtttgtttagctttatgctttgatttgcaggatgttaatgtctgatgtgtcaactgttaacaattggcatcccagctattaataactgagaaatcagttgttaatagctgacaactccttcattatagactgataaatggtttgaaatggcttgaaaggacaggttaaatgagtcagttgttacggtcaagtcatttcaatcgacagttgtttcagatagtttcaggcgcttgaaacttttagtttcattgcttgaaaccaatggtttcaaaggttgaaactattagttccaaggcatgaaaccttttgtttcaaggcatgaaaccgaatttggaactacttcttggagaataatcttgtaggagagatgggaaaaggaaagccttggtgacttcgaggcaaataaagaagatcggcttgcactgcgacgattgtcgtgtagcaagccgacctttatttcattttatctatgtatcttatacgttctttaccttgatcagatactcagcgatctgtacagcattcagtgcagcaccttttttgatctgatcgccaacgatccagaatgtcagaccgttttcatttgtaaggtctttgcggatacgtccaacgtacacagggtctttgcctgcaaggaacaacggcatcgggtattccttttcagcaggattgtcctgaagaacgagaccctcgcctttggcgaatgcttcacgggcttcttctaccgagatcggacgttctgtttccacccagatgctttcagagtgagcacgaagtgcgggaacacgtacgcaggttgcactgactttcacgtcagagtgcataatcttgcgtgtttcgttatacatcttcatttcttctttggtataaccgttttccgtgaacacgtcgatctgcggaatcaggttgaatgccagctgataagcaaacttctctactgtcacaggctcgttggccaatacctgacggtattgttcgtacaactcgtccatagcggcagcaccggcaccgctggcagcctgataagtagatacgtgcacggtttttatatgagaaagctgttcgatggctttcagtgcaactaccatctggatagttgtacagttaggattggcaatgacgccacgcggacgctccaacgcatctgcggcatttacttcgggcactaccaaaggcacatcagcgtccatacggaaagcgctggagttgtcgatcatcacagcaccgtatttggtgattgttttctcgaactccttggatgttcctgcaccggcagaagtgaaagcaatgtctactcctttaaagtcatcgttgtgttgtaagagtttgacctcgatctgtttaccgcggaaagtataggttgttccggcactgcgtttagaaccgaacaaaactaactcgtccatcgggaaatttctctcatcgagcacgcgcaggaattcctgtcctacggctccgcttacgccaacaatagctactttcatctttttcttttgttaaatgtgaataatgtggttaatcgctgcaaaattagaacattttatcatataatcagcattttggagatacttcttcacattttatcagttcccatcctttaaattggagcaaaatgcaatgcaatgcagtcccttcactgatagttgttacctttttatcccggctatattgttttagttgccctctgccttcttccgcttgttcttccagttccttatcggtggcggtgcgcgggaggtattttaattccagaatataactgtgtgccgtgtccgggtagcgggatttgtccggcaggaggaaaaagtcacaatatccgtaattcatctccaattccggctgaaccagataataagaagcaagagcaaggtatgctttgaagaaaccttgcaaattgtgttctccctcgatggcatcgcggatggcggagttttctttataggcaagggctatgtactcaaacagagggcgccattgtccgtcgaaggccatgtcgtcaattaaatcttttaagtgaggcaagaatacttccttacgctgctggtagtattcccgaaggaatccgaaatactgctcacggacgcaattgttaggaatgcacatcacaatacggtctccacgtgtgccgcacattgtaagcagtccataataataaagcaggctgcggaaattgtctgtttcaacaatcttctctgcgggaaaagatgtgtggaggtttaccagtatctctcctttagcagctatctcttcaatcgtactcatgcggtctcctcccgatacattctcatggtcgaggcgtgccagcattttcaatttgctgtagtccgtacggatattcttgtcgaccaattcttccggagatgcgtcgaaattaacccggtgacgcaaataatatagtgtcatgtcgcaattgaacattctcggatcggtcttcaagctggctttggcaaagcagtaattgtcataccacggtttcatttcattaatcatggcatctatatctcctttcagcataccttctttctgataatagtcgaacatctcccgtacatctgtttcactgaatcccatcatcatattgaagtgcgggtccacactgatattccagtctatgttatatccgctggataagtcgtccagcgtaacaggacttacccccatcaggaagatgcgttcgaacatacccttgaactgcttgaagtattcccggtagaagccgctggcatgggtcaggtcgcggaaaaggtttttcccctgttcactcaggatgacattcgtaaagttgtcatattcatcaatgatgaggtagagcaaatgtcccaggcggcgggcggtggcttccagccaatgcagctttgtagcggcttcggtagaagcgatgatttgctccagttctttctcgccttggtagtattcccggtaagtactgaagaagtcgttcaactgtatgcagcaataattgttgaagttgtcttccagacttccacgtcccaggtttgctttggaaaagtcaaaatagagcacctggtagattccctgaagcggggtggggtgcttaccgatccatagattgccgaaccgttcttcaaaacgatctttctgtgaaatatcgtaataggcacgcatcatggtgagaaatacactcttgccgaaccgtcggggacgaataaggaaaaggtagtttgctatttcttctatctggggaatgaaatgcgttttatctacataataataattttggtctatcagcctgctgaagtccgatatgccataagggattccttttgccataatgcgttcattttattgggatggatgcaaagttaagttttctttttatctccaacaactatccttctgcaattgttgctattattcctattaaataaacaggaggatgagatttataatacctgcattgtgattctgcgaacttttttgttcctttgcgtagaaatcctaaaaccacggacctatgaacctgtttgaattcaatttagcgttaccgataaccgatccgacttgggtgttttttctggtgctaattatcattctctttgctccgatgattctggggcgccttcatatacctcatattatcggtatgattttggccggtgtgctgatcggcgaacacggattccatgtgctcgaccgtgacagcagcttcgaactgtttggtaaagtggggctttactatatcatgttccttgccggactcgaaatggacatggaggacttcaagaaaaaccggatgaagagcgttgtcttcggcttgcttactttcctgattcctatggcgctgggtatatggagcagtatgagcatgctgggatacggtttccttaccgcagtgctgcttgccagtatgtatgcttctcacactttgattgcttatcctattatcagccgttacggattatcccgtctgcgcagtgtcaatattactatcggtggtacggccattacggtcactcttgcccttatcatccttgccgttattggcggaatgtttaaaggcaccgtcgatggtctgttctgggtgttcctcgttgcgaaagtagccttccttggtttccttatcatcttctttttcccccgcatcggccgctggtttttccggaagtatgacgacagcgtgatgcagttcgtgttcgtgctggcgatggtcttcctcggaggcggactgatggagtttgtaggaatggaaggaattttgggagctttccttgccggattggtcctgaaccgcttgattcctcatgtctctccgctgatgaaccgtctggaatttgtgggaaatgccttgttcattccttactttctgatcggtgtcggtatgattatcgatgtcagaagcctgtttacggggggcgaagcattgaaagtggcggtagtcatgacagtggtagctactttcagcaaatggcttgccgcatggatcacgcagaagatttaccgtatgcagcccaatgaacgcagcatgatcttcggactcagtaatgcacaggcggcggctacgctggcagcggtgctgatcgggcacgaaattatcatggaaaacggagagcgtctgctcaatgatgacgtactgaacggtacggtcgtgatgatccttttcacctgtgtcatcagttcgctggtaacggaacgttccgcccgccggtttgcactgaacgaagatgcgcagcccgaagataagggagcgaagaaagcgatggagcagattctgattccggtagctaatccggaaacgattgagaacctggtgaatctcgccctggtgatcaaggatgccaagcagaagaatggcatgattgccctgaatgtgattaatgacaataacagctcggagaataaggaactgcaaggcaagcggaatctcgaaaaagccgcaatgattgccgccgccgccgatgtgccggtgacgatggtaagccgctacgatctgaacattgcttcggggattatacatacgattaaggaatatgaggctacggatgtagtgatcggtctgcaccgcaaggcgaacattgtcgattccttctttggcaaccttgccgaaagcctgctgaaaggtactcaccgcgaagtgatgatagccaaattcctgatgccggtcaatacgctccgccgcatcatcatcgccgttccgcccaaagccgaatttgaaaccggtttttccaaatgggtagagcatttctgccggatgggaagcattctcggctgccgtgtgcacttctttgccaatgaacgtacactgatgcgtctgcaacaactggtgaagaagaaattcagcggtaccccgaccgaattttctctgctcgaagagtggggcgaccttctgctgctgaccggacaggtgaactacgatcatttattcgttgtcatctctgcccgtcggggttctatctcgtatgatccgtcctttgaacgtctgccggcacagctgagcaagtatttctccaacaacagtctgattatcctgtaccccgaccagttcggcgatccgcaggagattgtgtctttctccgacccgcgtggttacaacgaatcgcagcattatgaaaaggtgggcaaatggttttataaatggtttaagaaaagctgatggaagaaaataactggcaacaacggacagaactcctgttgggagaagagaaaatgaagcgcatccgtgcttcgcatgtattggttgtcgggctgggaggcgtgggggcgtatgctgccgaaatgctttgccgggctggggtaggcaggatgacgattgtagacgcggataccgtgcagcctgccaatatgaaccgtcagcttcctgccatgcactccaccctggggatgccgaaagcggaagtgttggcggcacgctacaaagacatcaatccggatattgaactgaccgttttacccgtctatctgaaagacgagaacatccccgaactgttggactctgctaagtttgacttcatagtggatgccatcgatacgatcagccccaaatgctttctgatttatgaagcgatgaagcgtcatataaagattgtttccagcatgggcgcaggcgcgaagagcgatattacgcagatttgctttgccgatctttgggatacctatcactgcggactcagcaaagcggtgcggaagcgtttgcagaaaatgggagtaaagcgtaaacttcccgtcgtattcagtaccgaacaggcggacccgaaagcggtattgctcacggatgacgaacggaataagaaatcgacctgcggaacggtcagctatatgccggcagtcttcggctgctatctggcggaatatgtcattaaacgaatctaagaagctattatgataaaattagaaggaataaccaagagttttggttctttgcaggtgctgaaaggcattgatctggaaatcaataaaggtgagatcgtcagtatcgtaggacctagcggagccggaaaaacgactctcttacagatcatgggaacgcttgacgaaccggatgcgggcacggtggcgattgacggaacggtagtcagccggatgaaggagaaagaactgtccgctttccgcaataagaatatcggttttgtgtttcagtttcatcagcttctgccggagtttaccgcgttggagaatgtgatgatccccgcatttatcgccggagtatcgtctaaggaagcaaacgaacgtgctatggagatactggctttcatgggactcaccgaccgtgcttcccataagccgaacgaactgtcgggaggagagaagcaacgggtggccgtagcacgtgccttgattaaccatccggcagtcatccttgcggacgaaccttccggaagtctcgatacacataataaagaagatttacaccaattgttcttcgacctgagggaccggttgggacagactttcgtcatcgttacccatgatgaaggactggccaaaatcaccgatagaacggtacatatggtggatggcacaattaaaaaagattaataaggaaaccaaacttctaaaaatggataccaaatcactagaagattgtgtgagttcaatcttttagctatatatttatagtcgcttctctacgtaagtctgtgaagatgtcagtagagtgtttgttttgtttgtgtgtgatgcattcttgtctggtgtgataggaatgcatctttttttatatatcacaacaaatacgattttagtcgtaacaaacataaggcgccattcgttcgaaatctgcgggtgtgaattcctcgtaaagcatcagttgtttcaagtctcttactttccccttcttcttccggtactctgcaatgaccttggcttgataatagctgatgtacggatgatgcatcattcgctctacacttgccttattgatgttgatccggtgaatctttccagcatccacggagaaccacgaacggagcttttccgcttttaaccgaatctcccctaactgttctatctgatagaatcctcccaataaccggcgatggtttacaatcgatcgggcaatccggcttccgatccccggaatctttttaagttcggtggtatccgcctgattaaggtcgatgatagtgcccggcgggtatttcattaaagtatcatatggtgcagtcgcttgtactactaatatccggctggtatcttgaaggaccggtgtttcggcaatgcgtatatacggttgaagagtccggtattgttcttccgtcagcccgtatattttccgaaagtcttccggacgtcggaatctgccttgctttctgcggtatcgcagaatattgcccgccatccaggtaggcaagccgagactgaggaaagtggcggagtcggcggtattcggatcgaacgctgccggtctgatttcttttttcggataggcgggcgatgaatacctgcctctgtaaactggatatttcttgtcctgctttgcttcttttatggaagagataaattcattatattccttttcggatttcgcctgttcagtcgggtcggttttctccggtccggagaaagcctgcaagagtgcggggattgtgtatacccctataacaagaacgacaaggacgataatgccttgtcgttcggttttagtaaaataaaaaaagtctttccacattatagtttgataagtcccaactcattgataaagatcagagagatggcaatcggtgcaatatatcttaatataaagatgatcagtttgtatacgggaactttcagcgaaccgtcattggtgatctccgaccagacgattttcttgtcgagataccatccggtaaagatggaaatgcacagaccgccgagtgtcagcatgatcttagccgtgacaaagtcgaataagtcaaagattcccaatccgaagatggtgaatcctttcatcactccgagcgacaaagaacaaaggatacctaagaagatacatcctccggtcaccagtctggctgccttgccgcgtgtgaagttgaattcttcgtgcagataagcggtgaccacttcgtgcagggaaatggtggaagtcagtgctgccatggcaagcaatacgtagaacatgacggagaagatataggccaatatcggtactccgctgaatgcctgctggaatacattgggcagtgtgataaagataaggctcggacccgcatccggttgtatgcctacagaaaatgcggccggaaagataatgaagcctgccaatactgccacaaatgtatctataatccctacgctgaatgctgtcttggtcagattggtttctttgctgaaataagaagcgtaggtgcagagacatcccatccccaggctaagggagaagaaagcctgtcccatcgcactcagaaatacatttccgtccaccttgctgaaatccggtttcagcagaaactcgatacccgcaccagctcccggcagggtaaccgaacagattacaagtatcaatataataatgaacagagtcggcatcatgatcttggaagatttctcgatacctttctccacgcctttgacaataataaaatgagtaaccaacagaaacagaaccaaccacaagaccggtcgccacggactgctggagaactgctggaaggaagagatgaattctgtgggagtcttacccgtaaagccgttcgtaagagcttcatacacatactccagcgtccatcctgccactacggaataataactgagaatcagaaaagctgcgaggactcccatgcgtcccacccagcgccaatgagtgccgggagctaatttctgataggctcccgctgtatttgccctcgaacggcgtccgattaggaattcggcaatcaaaatgggaagtcccaaaaggaaaacgcatcctaaatagatcagtataaaggctgcgccaccgtgattacccgtttcatagggaaatctccagatgtttcccaatcctactgccgagccggcggaagcaagtattacgcctaatttacttccgaagttcgctctatcaattttcgtcataaatcttgttttgtcttacaaatcgttataaaatgtacgtattaaaatgcaaatatagaaaatgatagttatatttgtaccggaatcgtaattttatttagatatgctatcttatattaagaaatatcctatttcactttttatcatcttaactgtgatttatctgtctttcttcaaacctcctaaaacggacttgaatgaaatccctaacttagataaattagttcacatctgtatgtactttggtatgtcaggtatgttatggctggaatttctgcgggcgcatcgtcgtgatgacgcaccgttatggcacgcatgggtaggggcattcctctgtcccatactgttcagcggctgtgtggaattgctgcaagaatattgcacgacttatcggggaggagactggctggactttgccgccaactcggtgggtgccatccttgccagtttagtggcttattatgtggttcgtccgcgaatgatgagaagggaatagaagactgtagtaatgcataatcatactcatgcctatgagaaaaaattctcattgcagtgagaaaatattctcataggcatgagtattttttctcatcgtggtgagaattttttttcaaaggcatgagaatactttgagaaattaacagcgatattatagataatctacaaccgaactgagtttaattccgttggaccctttgatcaggatagtgtatcctttcggcttgtcggcctccagttcctttattacttcctgtacgttgggataggtttggaaggagtgctctgctgctgcaaactgatctcctaccagccatactttttcgaacgcgcattctttgaggtagtctgctatcttctgatgttcggcagcgctttcggcacccagttcgcgcatatcaccaaggatgagcattttgtgaggaacttccatgttgcggaagttctgtaaggcagccatcatgctggtcggattggcgttgtatgcgtcgatgatcagtgtgttatcgtccgttttctttagttgcgagcggttgttctgtggtgtatatccggctaaggcttcgttgatctttgcatcttccactccgaagaagcgaccgatggtgatggcagccagtgcattggggaagttgtattctccgatcagttgcgtctgaacctgataggatttaccatccttgcccgctttccattcgaaagtgagataaggggagttgccggtgattcgtccgtttacgtaaaggtcatcttcggtgccgtaagggatcaggttcagtccttcggcaatgttcatcagataagcattgtcgtgatggataaagacggtagaaccttctttcttacggagaaagtcataaagttctcctttggtttttatcacaccttcgaaagaaccgaagccttccaaatgggctttgcctacattggtgatgataccgcagtccggctctacgatttcgctgaggaatttgatttctcccggatgattggcgcccatctcgatgacggcaaggtcgtgttccgctttcaggcggagcagggtagagggcacgccgatgtggttgttcagattacctagcgtataaagaatgttgtggctctgagagagtacggcggagatcagttccttcgtagtcgtcttgccgttggtaccagtgataccgattactcgtgtacccagctggcggcggtggtaattggcaagctgctgcaatgtttgcaggcagtcgtctacgagtatatatcgttgatcgccttcaatcgcgtattcggattcgtcgatgacagcataggcgcaaccggtttccaatgcttttccggcaaaagcgtttccattgaatgactcgcctttcagagcgataaacagtgatccttcaggacagttccgactatcggtcgtcactaattggcaatccagaaatatctggtaaagagcagaaagtttcatagcctgagcttttatttttaaatgttgcaaagataggctattctttcggatttggtatcggtcagaagcgttttttactcagcatataccaaaggaagagtcagcaccatccggcacccgtccgtataggatgaatcgatgtggaggctgcctcctaacttttcggcaatcgtccggctgatcgacagtccgaggcccgtgccctgtgagaaggagttcattttgtagaagcgttcgaatactttttcctgtttctccttagggattcctataccggtgtcggtaacgctgatctcgagtttcttttctgcttccaataccgaataagtcagttcgatgctgccatgagtcgtgaatttgatcgcattgtgtgccagattggcaagtaactgcgaaatgcgttccggattgctgagtatgattagtttttccctttccggtttgaaaaggaattcgactgtgtcttgtttctgcattttagctacttcgatagatagctggcagatcatattgatatccgtttggatatttgtagggagcttgttatattggtcgagctccgacaatgcgagcacatcggtcacgagtcgaagcagatcgtccgtgttggctttgatgatgttgacgaattctttcgtttcctcattgccgtagtggtcacttaatacttgtgagaagcctatgatcgaattgagcggtgtccgtatttcgtgagacatactctgaataaaagtcgttttcatctggctggtcgcttctgcctgatctctggctttgcgcagttcttctctcgaataagtcagttcttcgttcttatttcttaattcactttccgaggccttcagcctccggttcagacggctttcccgatataagaacaagaagaggatggctaacaggatgatcaatgaaaaaatcagcgtcgttttattgctcaactccttttcttttgtccgaagcattaattcctttttctccgcattgagcttttctacatttagcagcgtggcatattcgctgctcgccagttgttcattggctattttcaaagaatcgtctacttcaatatactttttcagaaatttcaccgcttcatccggtctgcccatctgtctgtagatttctcctttgaggcggtattgtccgctgctcatggcgtactcattcagccgttgctcttcggttttctgcttctcgacagcttccagtgccttgacgaactgtttgctgcgctggtagtagaaagcctctgtgcggtaaaacctttttttgagtgagtccagccttttgtcctggtcgaacagttccctgcattctttcagcatcttctccgctgctgagaaatctttaaattcactgtaatactctacgtatgtcagttttgccagtattttatggctggcggagttggctgtttttactgctttttccagtgcttccagcgctggttccggctgatgatgcgtaatgtagtaattggcaagttgagcgtaagtattactgatattatagttttctaatttgtatttttcggtcagttcgatttctttcacgcgccattcggacgccatgacatcaaagttcttgattgtgtaaatctgcgacatgatgttgtagcagtacatgagtccggtcttgttgtcctcggcttgtgcctctttcagcactttttcggcttcatagagggcgatgttactccttccggttttcaggtaatataggatcagccggttggcccaggcgaaatagtagtacttggactgctgtatttctttagcgaattgttttaccttattggtataaaaaatgatgctgtcttcattattggcctggtaataataatagtccagccgggtggagagagctaccgcctgcatccgctggtcgttttgtccgctagccatacggaacagcgtatcggacatactcagcacgaccggttccagcaaatgttcctggcaacgctgatagtaggcatacaaagaggaatcaacgttataaacttcagcttctttctgggcttttgcaggaataacgatgaacaaaaaagagacaaggtatcctaagataattcgggacaatcggctcatggtattcgttttcggtagttctattgattgctattgattgcaaatatacgtttatttcctaattttaatacgaatacttgctttttttatctacatttgcaacagtctaactggaatataatcaagaatgaaattgatctctccaacttatataaatgtgaaaggacgtctgctcgatcttgctactccgcaagtgatgggtattctcaatgtgacacccgattctttttattccggcagccggatgcagacgcaggaggaaattgcagcgagggcacggcagatcatcgatgaaggagcctctatcattgatatcggagcttactcctcgcgcccgaacgccgaacacatcaccgccgaagaagaaatgaaccgcttacgtaccggactggagatcgtaaaccggaatcatccggatgctatcgtttcggtcgatactttccgggcggatgtagccgaacagtgtgtggaggagtatggcgtagctatcgtcaatgatatcgctgccggtgagatggacaaccggatgtttgagactgtggcccgcctgggagtgccttatatcatgatgcacatgcagggaactccccaaaatatgcagaaagaaccccattatgataatttgatgaaggaagtgttcatgtactttgctcgcaaggtgcaacaacttcgtgaattgggtctgaaagacattatactcgatccgggttttggttttgggaagacactggagcataattatgagttgatggctcacctggaagagttcagcattttcgaacttccactgttagtcggtgtttcccggaaatcaatgatttataaactattgggaggaactccgcaggattcattgaatggaacaaccgtactggataccgttgcgttaatgaaaggagcgaacattcttcgggtgcatgacgtgcgcgaagcggtggaagccgtccggattgtggataaactgagaactgagagtgaatatggcaaatgatagaatggcattatccgttggtgatactctcttgtcgtttgtgaattaataacttgtaataagtaataagtaccgtgttttttgacgttggcataaaagattttatcgatgtactgctggtcgcccttctgttgtactacacctacaaactgatgaaggcctccggctctatcaaggtttttaccggcattctggtttttatcctgatctggctggtggtcactcagattctggagatgaaactgctgggctccatattcgataccttgatgaatgtgggtgtgattgctttgatcgtcctttttcaggatgagattcgtcgtttcctcttgacgctgggctcgcatcggcatgtcagtgcattggcgcattttttcagcggggcgaggaaagaagccttgaaacatgatgatatcatgccggtggtaatggcttgcctgagcatgggaaagcagaaagtaggcgcattgattgtgatcgagcataccactccgctggatgaagtggtccgtacgggagaaattatagatgcggctatcagccagcgtctgattgagaatatatttttcaagaacagtcctctgcacgacggagcaatggttatcagcaaaaaacggatcaaagccgcaggctgtatcctgccagtctctcacgacctgaacatcccgaaagaactgggcttgcgtcaccgtgcggctatgggcatctcgcagaaatcggatgcgcacgccatcatcgtctccgaagagacaggagctatttctgtagcttatcgcggacaattctatcttcgtctgaatgccgaagaactggaaagtctgctgacaaaagaaaactgaaactaaatataagtgaacatggacagacgaaattttctaaaaaccggaggtatagctctactcggatcattggcgacaggttctgctatggctctgactaccccgggtgcattgggcggcgaaggagctgacaagaaagcagcagttgctttggctatgaatcatttcggagtaagcgaggcagacttgaagaaggtgcttgccgcggcattggagaaaggaggcgattatgccgaccttttctttgaacacacgatatccaacagcatccgcctgatggatggtgcagtgaacaacagttattcgaatattgactatggagtcggagtccgtgtactgactggagaccagagtggctatgcctacgtggagaatattactgtggaggatatgctgaaagctgcccgtactgccgcccgcatcgcttccgccaacaaaggcaacaaaccgctgaatctcaccgaaaaggaactgaagaagaactattataccgttgcttccccgtgggaggaagtcagtttgaaagataagatgccttatctgcaaaaactgaacgaccggattttcgctttggacaaacgggtacataaagtacaggcaagtcagagcgataccacttcgcatatcttcttctgcaattcggagggagtgatgttctacgattaccgtccgatggtgacgctgggtgccgtgtgcatcatggaagaagacggaaagacggagaacggctacgctgcccgtgcttaccgcagaggattcgatttcctgtcggacgaggtagtggacgtaatcgcccgcgaagcggtagaccagacttctcttctgttcaaggctatcaaacccaaaggcggtgaaatgcctgttgtcatgggtgccggaggatcgggtatcttgcttcacgaggctatcggacatacttttgaggcggacttcaaccggaagaatgtttccatatttgccgatcagctgaataagaaagtatgcaacgaacatatcaacgtggtggatgacggtacgattccgttcaatcggggttcggtgaatttcgacgatgaaggtgccgaaggacagaaaacttatctgattaaagacggagtactgactagttatctgcacgaccgtatcagtgcaaagcactacggagtggaaccaaccggcaacggacgtcgcgaatcgttccgcaatatgccgataccccgtatgcgtgctacatatatggaagccggaaatgtgagcgaatcggatatcatttcttctgtaaagaagggaatctttgtagataactttacgaacggtcaggtacagatcggtgccggagactttacattctttgtgaagtcgggctacatgatcgaagacggtaaactgacgcaaccgatcaaggacattaatattatcggtaacggtccgaaagctttggcggatatcacgatggtagctaccaatgcgaagatcgacaacggtacatggacttgcggaaaagacggacaatcctgtccggtgacttgcggtatgccttcagccttggttagcaaactgactgtcggtggagagaactagaagtaaatgcttactttaaaaagacgaacctatgattacagacgaaaataagaaactggcacagtgggcgatggactacgccttgaagaatggctgccaggcagcaaaagtccttttatactcttcttcgaacacttctttcgaactgcgcgatgcgaagatggacagattgcaacaggcatcggaaggcggattaagcctttccctgtatgtggacggacgttatggtagtatctctaccaaccgcctgaaccggaaagagctcgaaacatttatcaaaaacggaatagactctacacgctatctggctaaagatgaggcgcgtgtattggcggacccttcccgttactataaaggtgggaaaccggacttaaagctatatgatgccaagttcgcatccttaaatccggacgataaaatagagatggcgaaagccgtagcggaagaagcactaggcaaggacgaacggatcatctctgtcggttcttcctatggcgatggcgaggactttgcttaccgcctgatcagcaatggtttcgaaggagaaaccaaaagtacgtggtactcactttctgccgacatcacgatcagaggggaaggcgaggcgcgtccttctgcttattggtatgagtcgtcgctttatatgaacgatctgattaagaaaggaatcggtcagaaagcgctggaacgtgtattacgcaaactgggacaaaagaaagtacagtccggcaaatatacgatggtggtcgatccgatgaattccagccgtttgctaagtccgatgatcagtgcgctgaacggctcggctttgcaacagaaaaactcattcttattaaataaattgaatgaaaagatagctagtgaccggctgactttgacggacgaacctcatttggtgaaagcttccggcgcccgctacttcgacaacgaaggtattgctacggaacgtcgctccatctttgacaagggagtactgaatacctatttcattgatacctacaatgctaagaagatgggagtcgatccgactatcagcggttcatctattttggtcatggaaacgggagataagaatctggatggactgattgccggagtggaaaaaggtatcctcgttacgggctttaatggtggtaacaacaacagttcgaccggagatttctcttatggcatcgaaggtttcctgattgagaatggaaaactgacgcaaccggtatccgagatgaatgttaccggcaatctgattaccttgtggaactcgttggttgcaaccggaaacgacccgcgtctgaactcctcctggcgtatcccttcactggtatttgagggagtcgatttcagcggattgtagacactgactttgaatagacttaagtaatggtcaggagatgatggtcataaaatggagatcatctcctgaccattactgtaatattaccctctgaattttataaatataccctgctataccccgtcttctgcctaactaatgctttattaattaacgtattatctggtttttgcttacctgtatttataccccctctttgtttgctaatttgtgggatgctgtttacttttgcctgtgtcaaaattaaataggatataactattgaaaactgatatacacacaaaagtaaaagcatgggaattatatattttggatcgggacttatactgctaatcgcactttggtatatttgggcagtcaacaatttgatcgctaagcgaaacagggtgaagcaatgtcgtagcggtatttgcgtggcattaaagcagcgaaatgacatgatacctaatttggtggccgccgttaagtcatatatgggtcatgaaaatgaaattcttacccgcattacggaacttcgatcacattctttccaaccttcacaggaagccgaacaaataaaaagtggcaatgaattgtccggtctgttaaccaaattacagttgtcggtcgagaattaccctgaactgaaagcgaatgaacaattccatcgcctgcaaaacagtattgaggacatggaactgcaactgcaagccatccggcgcacctataatgcggcagtaacagactacaataataccatcgagatgtttccttcttccgttgttgcccgtcagcaaggtcatcatcaggaagaactgattgatattcccgaaccggaacaacagaatgtaaatgtcgccgaacttctcagataatacgaatatggacacaattgattttaagaaattatcagaacagcttcgttcggagcttttacgggtaaatggctggagaaaggtggtacgaacaggaagtattgcagtttatctttttgtattctgctggtttatgtttgtgttgtttggcggtgcgcttgtatcttatataggtcttgagaactatatgcagtttacgcagtatataataccagtattcattggatttatagtggtcaacttcgttttcactcgctgcatggcgaactttcaggaacgggagtcggaggctatgcagcacattatgtctaccctgtttcctaccgtttatttctcggcttcctctcaggtagacagccggatattgagagacagcaaactcttttccgcctctttttctgatccggcactggcagccaatacgtatggatatatccagtttccgcacggcgagcactctttgcatgtggcggatatcggcgtgtcttacgggctgttgaacaagttgcagtacaatcctgtattgggatattttgtcatgatctaccgttttgtgcttcgtccgctgtttgcttcgcggctggatagcagtccgcacaattttcgggggatgtttggctggtgtaagatagacaagcgattcaaaggaaatattatcatattgcccgatcacctggaacaaaagatcggatatctggcgaagaatatccaggggttgaagaagcgctatagtgcccgactggtgcaattggaagatcaggagtttgagaactattttgccgtttatgccgatgatgaagtagaagcacgtatgttgctcactcctgcgatgatgcgtcatatgacggcgctgcaccagactttcggatgtgatatcatgctttcgttcagcagaggtactttctactatgccgccgtgatgccttccggttttttatgtgtgcgtccaagtgcgttgaatgacgggaagctgcttgaggacatatataatgatatcagcctgtcctgcaaagtggcagaggaattaagattgaattagtattaacaataaaacaaaaacactatttatgacagacatgagttggatgccttgggtcgtaggcggagtaatggtcctttcttttctttatatgaaggtatggccatttgtccgtactattataagagcttttcgggggcctcgttttaaatcaaaatcaaaattatccgtagaacagtataaaaaactgtctataggttcattgtatgccttgcagcaaggcggatatctgaacactctctcgttggatatcaaagataagttgcctactattcttggtgaatggtggggaataaataatgctcatgatgcccgcgaaacattggatgatttgtgccggaaaggttacgattactactttccgtttgtttatgaggcttttttgcttgacgatgaaaatgcgcaagacgatattttccagcagaacatggagagtcaggaagattatgaaaaagctgtcgggcaactgcaaaatttgaaagaggtctatgaggagttgatagcttatgaagtgattacttctaaagaagatatagcccgctatggagtgattggctgggatgccggcagaattaattttgttgcccgtgcctgctgcgatatgaaatatatctcagaaatggaagcgtggaattatatcgacaaggcgtatgaactggctcattcttcttttacatcatggcacgatatggcgatgagttatgttattggcagggctatctggggagggaccaatgctcacaatttaggaatgaagggaatggcagacgatctgttgtctaatcctaagagcccttgggtgcaaatcaaatggtaaattgatcaagatagtttaatcacaaaaacacataattatggaacaaaagaacaacaagtactacagttacatcagcgagtattatgccgccaacccgactaaatttgaaaaaagaaagaacaatctgaaacctgtgttatatttaggtttggccgtggtaggagccgttctggctatttttcccggtttgcttccattggcaggctggttggtgcgtacagccggaatcatcatgacactggtttgcctgatagctgcctatctgaataactttgatatatacaactttcaaagtggaggaaaagtcaagagtatgggagtcaagaagtttaagcgtgatgagacaaaccctgcgaagatagtggaagctttcttatccaggaactttgaatatctggcagaccttcccggaggaagaagtgaaccggtacaacttcatattgaagaagacgccacaggacgtgaaatgtactgtttgctgaccacttatgattcagattcgaatattgtaggtttggcagatgtcatcactttatcgggtaatgattatgatgataatattgatctaattaaacaaatgtttaaagacgaagaagataattgattcatcggggctggattataaaaacagctctgaggagaagaaaactcttctaaatggaagaaaaaacacaagaaagaaaaacattcatactataaaggaaatcgaccggaggggtgggtacagacacaagtaacctgtcaacaaaaggtcgtatttcctttaaaaataatctgtctcaggggattttgctttatttctaaccttttttgaatgataattggtacctgcggtttaggtgaatcgcctatctttgccgtatactatatataattataattctatattgagataaaagccatgagacacagatttattgctttactagtactttttacagtcatctttttcagtagtgcagaggcgcagactactgcccgtaagtttgaggcaggcaagaatactttcttgctggacgggaagccgttcgtagtaaaagctgccgaactgcactatacccgtattccgcaagcctattgggatcatcgtattgagatgtgtaaggcgttgggaatgaacactatttgtatttatatcttctggaatatacacgaacaggaagaaggcaagtttgactttacaggtcagaatgatatcgctgccttctgtcgtgccgctcagaaacacggaatgtatgtcatcgtccgccccggtccgtatgtgtgtgcggaatgggaaatgggcggcctgccctggtggttgttgaagaagaaagatgtggcactgcgcacgctcgatccttattatatggaacgggtaggcatcttcatgaaagaagtcggtaagcaactggcgccgctacaggtaaataagggcggaaatattatcatggtgcaggtggagaacgaatacggttcttacggcactgacaagccttatgtttctgccgtacgcgacttggtgcgcgaatccggttttaccgatgtacctctcttccaatgcgactggagcagtaactttacacggaatgcactcgacgacctgatctggaccatcaacttcggaacaggcgccaatatagaccagcaattcaagaaactgaaagaacttcgtccggaaactccgttgatgtgcagcgagttctggagcggatggttcgaccactggggacggaaacatgaaacacgtcctgccaaagatatggtacagggcatcaaagaaatgctcgaccgcaacatctccttcagcctttatatgactcacggaggaacgactttcggacattggggtggtgccaacaatcctgcctactccgctatgtgcagttcttacgactacgatgccccgatcagcgaagccggatggacgacagagaaatactatctcctccgtgacctgctgaaaacgtatcttcctgccggtgaagcactgccggaagtccctgccgcaatgccggtcattgaagtacccgaatttcattttaccaaagtagctccgcttttctccaacttgccggatgccaagcagtcggtggatatccagccgatggagcaattcaaccaagggtggggaacaatcctgtaccgtaccacattgcccgaagcagtaacctcaggcactacattgaaaatcaccgaagtgcacgactgggcacaaatctacgctgatggcaagctgctggcccgtctcgaccgccgcaaaggagaatttaccactaccttgccggccttgaagaaaggtacgcaactggatattctggtagaggcaatgggacgtgtcaactttgataagtccatccacgaccggaagggaatcaccgaaaaggtagaactcctttcgggcaatcaggtgaaagaactgaagaactggactgtatataacttccccgtagactactcatttatcaagaacaagaactacaaggatacgaaaatattaccgattatgcctgcttactatcggtcatctttcaaactcgataaagtaggcgacactttcctcgacatgagcacatggggcaaaggtatggtatgggtgaacggtcatgcgatgggacgtttctgggaaatcggtccccagcagacacttttcataccgggctgctggctgaaagaaggcgagaatgaaatcctcgtcctcgacctgaaaggtccgacgaaatcatcaatcaaaggtctgaagaaaccgatcctcgacgtactccgcgagaaagcgccggaaacacaccgcaaggatggagaaaagttgaagctgacaggagaaaaggttgcgcacgaaggagccttcactccgggcaacggctggcaggaagtacgtttcgccgctccggtgaaaggacgtttcttctgtctggaagcactctctccgcaagccaataacaatattgccgctattgcagagttcgatgtgctgggagccgacggcaaacccgtatcccgcgaacattggaaaatccgttatgccgatagcgaagagacacgtagcggaaaccgtacggcggataagatattcgacttgcaggaatccactttctggatgactgttgacaatgtcgcttatccccaccaactggtaatcgacctgagcaaagtggaaacagtgacgggcttccgttatctgccccgtgccgaaaaggactttccgggcatgattcgtgaataccgcgtctatgtgaaaccgtctgatttcaagtattaaaccaataataagccaatatcggccttttgataataaagcattcactttataaataagcatttactctcaaatgaatatgaaaaaatatactttactcctggcactccttttagtaggagtgctgacaggatacagccagcaatctgcctacctgtttgtctatttcaccggaaacaggatgagtgaggaagccatccggatggctgtcagccccgatggatacaactactatgcattaaacggaaaccaaccggtcatcgattcccgtgaaatcagttctacgggtggagtgcgtgacccgcacattcttcgttgtgaagacggaaagacattttacatggtcgtaactgacatggtctccggcaatggatggagttccaaccgtgccatggtactgttgaaatcgaaagatctcgtcaactggacctccaacatcgtgaatatccagaagaaatacccgaatcaggaagatttgaagcgggtatgggcaccgcaaactatttatgataaagaagcgaagaaatacatggtctactggtcaatgcagcatggtaatggtccggacattatttattacgcatacgctaacaaagatttcaccgatatagaaggagaacccaaaactttgttcctcccgaagaatggcaaatcctgtattgacggagacatcatttataaagacggactttaccacctgttctataaaacggaaggagacggcaatggaattaaaaaagcaaccaccgcctccctgacttccggacaatggacagaatcggaagattataagcaacagacgaaagaagctgtagaaggtgccggcatcttcccgctgataggtacggacaagtacatcctgatgtacgatgtatatatgaaaggcaagtatcagtttacggaaagcaccgatttggagaatttcaaagtcatagacaatgccattagcatggacttccatccgcgccacggcaccgtaatgccgattactgacaaggaactgaaacgcttgtacaaggtctacggaaagcccgacaagatgtaaagccatcagatgcaccatctaatatcccataaataaataccatgaaaaaactcctgttgttcattttgcttgtctgtgcaacagtacaggcctattcgcaagaatacccgaaagtcgttttatcgggtgactatccggacccttctgtcatgcgcgatggcgaggattattacatgactcattctcctttttactacgctcccggattcctcatctggcactcccgtgacttgatgaactgggaacccgtctgccgtgtaatgcccgaatacgaaggctctgcaatggcgcccgacttattgaagtacaaaggaaaatactacatctattatccggccaaaggaacaaactgggtgatctgggcaaatgacatcaagggcccgtggagcaaacccatcgacctgaaagtgagtggcatcgaccccggacacatagccgatcaggaggggaacagatatttatatgttgacaaaggagaagtcatccgactgacggacgacggactggccaccatcggccaaaaacagaaagtgtacgaaggctggcgatatcccaatcactgggaaacggaatgtatgtgtctggaatcgccgaagctgaattaccataatggttattattacctgacttccgcacagggaggaacggccggtccggcaacaagccacatggcagttgccgcccgttcgaagagtgtcaccggaccgtgggaaaattctccctataatccggtagtgcatacctatagtgcccatgacaactggtggtcgaaaggacacggcacactgatcgacgatgtgaacggcaactggtggatcgtatatcatgcctatgccaaaggctatcacaccctgggacgctccaccctcatcgaaccgattgaatggaccgccgatggatggtatcgtaccaaatccaccgccactcccatcaagaccgatccgtccatcaaacacggactcagcctctcggatgacttcgaaggaccggaaccgggactccaatggactttctggaaagaatatgcccctcagtcgctcagcttcaagaaacagaccttatggatagatgcgaaaggaagtaccccttccgatgcccgcttactgctggccaccgccgaagacaagaattacgaaacacaggtggaagtcaacgtaggcaagggtaacacagccggacttcttctatattacagcgaaaaggcatacgctggagtcgtgtctgacggaaagaacttcactatctacagaaacgcggaaaacagctttaccctccctaacaagttgggcaaacgtttcctcgccaagatacagaatcagggaaacagtgtccggatagcagtcagcaaggacggcaagaaatggactacgctggtagaaaacatggatgtatctcagctgcaccataacaactacggcggcttctacgctttacgcatcggactgctttcctccggaaaaggcagcgccggcttccgtcagttccgttaccgtaacgccatcccacaggaaaaggacatgggtgcttacttgatggtcttccataaagacgaaacgcacagcctttacatggccgtcagtgacgacggatatacatttactgccttgaacgacggcaaaccggtgatcgccggagataccatcgccctgcaaaaaggtatccgtgacccgcacatcttccgcggaccggacggagctttctacctttccatgaccgacctgcacatctatgcgcagaaagacggcttccgtgataccgaatgggaacgtgacggaaaagaatacgggtggggaaacaaccgcggactcgtactgatgaaatcatgggacctgatcaattggaaacgtaccaatgcccgtttcgacctgttatcggcgggtttgggtgaaatcggctgcgtatgggcgcccgaagtgacttacgatgacaagaaaggtaaactgatgatttacttcaccatgcgtttcaagaacgaggcgaacaaactgtactatgtctatgtcaatgatgacttcgaccggatagagacactcccgcaaatcctcttcgagtatcccaacgagaaaatatcggctatcgacggtgacatcaccaaggtaggcgaccggtatcgcatgttctacgtttcgcacgacggaggcgccggaatcaaacaggccgtgtcagaccgcatcaacggtgattacgaatatgaccctcgctggtacgacttcgaacccagggcctgcgaagctcccaacctctggaagcgtatcggagaagacaaatgggtattgatgtatgacgtctacggcatcaacccccataacttcgctttcatcgagacttccgacttcgtgaatttcaagaacttgggacgtttcaacgaaggagtgatgaaaacgactaatttctcgtcgcccaaacacggcgcggtgatccatttgacaaaagaagaagccgccagactgagaagtcattgggaaaacaggaaatgacagagtatcagaccttttttagtgaatacatactctatttttgcagagatcttatattataatttataccatgaaacatttacttctactatttagtgtattactactatcgttgcagccggccgcatttgccgcaacgcatgaaacgactgctactcccgattcagtatccctttttgcttacgccacccgaggtgacgacggccgtagcggactccgctttgcatggagcatggacgggaaacattggtttgaaataggacaaaactacggctatcttcgttgcgattacagccgttggggatcgcagaagaagatgctcgatccgaatctgaaacaactccccggcggagaatggctctgtgtctggaagttgaacgaccacgacggatacggtcaggccagatcaaaagacctgatctactgggaagcccagcaatatccccgtacgactcccgattttgaaggaacaagagtcaaagcaaagattgccggacacgaagaaacgggaaccgtcagccaagtgccctggtcggtagtggacggactgacccggacgtacgaacggaaccaataccgtaactccctgtatggcgaacgccctgtacaggataaagaacgctttgccggactgaaaccgatcaaagccaccgtcacagcacaaccggaagaaacaaaagaaatcagcgacttattgatgggtatcttcttcgaagacatcaactactccgccgacggcggcctgtatgccgaactgatccaaaaccgggacttcgaatacgacccgtccgaccgtgaaggggacaagaactggaacagcacccattcatggaagctggaaggagaaaacgccacctttaccgtatcgacttcggaccctatccatccgaacaacccgcattatgccgtcttgaagacgaaccagccgggagctgccctgaccaacaccggttttgacggaatcgccttgaaagcaggcgagaagtatgatttctccttgtttgcccgtatcccggaaggcagcaagtccggaaaactactcgtacgcctcgtagatgctgacgacaccgtacagggtgaaacgacagttaccgtctcttcccgttcgtggaaaacgtataaagcagtgctgacagcaaaagcgtccgccgatacccgtctggaacttcgtccgcaatcggcaggtgaaatcgaactggatatgatttctctcttcccgcagaatacattcaaaggcagaaagaacggtttgcgtcccgaccttgcacagacacttgccgatatgcacccgcgctttgtccgtttccccggaggctgtgtggctcatggtgacggtttgaagaacatctatcaatggaaaaatactatcggaccgctggaagcccgtaaacctgcccgtaacctttggggatatcatcagagcatgggactgggttattatgaatacttccagttctgcgaagatataggtgcggaaccgcttccggtgctggcggcaggtgtaccttgtcagaattccgcctgtcatggcgatttgagaggcggtcagcaaggcggtatcccgatgagcgagatgggtgcttacattcaggatatcctcgacctgatagaatgggcgaacggtgatgcaaagaaaaccaaatggggcaagatacgtgccgaatccggtcatccgaagcctttcaatctgaaatatatcggcatcggcaatgaagacttgatcaccgatgtcttcgaagaacgcttcacgatgatataccttgctatcaaagagaaatatccggagataatcgttgtcggcacggtaggtcctttcaatgagggaacagactatgtggaaggctggaaactggcggacaaactcggtgttccgatggtagacgaacattattatcagtctccgggatggttcctgcacaatcaggacttctatgacaagtacgatcgctctaaaaaaacgaaagtatatctgggcgaatatgccactcacatccccggacgcagagcgaatatggaaacagctttgaccgaagcactttatctggctgctttggaacggaatggagatgtagtgcacatgagttcttatgctcctctgctggcaaaagacggacggacgcagtggaatccagacctgatctacttcaacaatcgggaagtaagaccgacaacgggatactatgtgcagaaactgtacggtcagaacgcaggcgaccattacatcccttcacagataaaccttgataatcaggacggtcgcgtaaaactccgtgttggttcttccatcgttcgtgacagtaagacgggggatgtgattgtgaagttagtcaatctgttgcctgtcagcatagagacggatgtccggttaccgggaatggatggtatccagtcttccgctacgcggactgtactggcaggtgcacccgagacgactccgcttccggtgacggatacgatagaggcaggaaccagcttcaagcaggaattgccggcttattcgttcacggtcatccgcttgaagacacaaaagggaaaaaataagcaataaactggttttcaataggggttagtttattttggggaggggtgctcacctatcatctccccctgtgggtaggggctgactaaaaagtcaatagtatcctaaatctcctccttcgggaaggaggagtacccgtagggggaggtggtaggtgaatacataatcctgtcatttacaaagaaataggaacaaacattatttctcctaccaccccgccctttgggcaccccttcttcccggaaggaggggagttttgagatactaccgactttttagttagcccagttttaggtattattgacttttgtgccttctcttttcttcttcataatagaaaagatggttttcatctttcaccgaatgggtagttcgtttgctgtctatagtgtaatcagccgtaagatagtactaaagttctctttaacctcttgcatctttgctttttcctatagggaaagtaggaataagacaccgatatctttagttgttcacggccgtgaacaggtctgatcacatccgtgaagagcattgctcacggtcgtgatcaactcttgccacggccgtgaacaactaacaatatcagtgtcttaatggaagaataaaggcactataagtgaaagataccggtagtatatggtatttgttgtataaggttaggggctggatataggggaacgtaataagtaacaagtaataggatggggaaaggtgacaataaaatgtgtgatatatggctattgtcaccctattatcaccccttattatcaccaaatgatttctgataatcagtttattatccttcaaaagtgataagtgacaatagaaaagcatgttattactatggtacgagttcgatataatccaacaagatggaccatatcgaactcgtgttagttatctgattatcgtcagtttatagcttggcaatcactttcttacctctataggagatggatttgtcaaaggtggttgagtctccgtcgccacagccttttcccggttctacaactatgaggttgaatttgcggcttttcagcattcctttgtagctgcctttccggtcgtcgatggtcagtgtacggtcttggtcgttccatttcaaggtgatggtggagtaagctcccttttcgtagttataattgtcgaactcatcttcgtaaagggtaaattccgcgttcgctcccggatagatacggatggtcagattgtcccatttcttttccgtagagtattgcacggcgggcccccaggggagaatagagccggcacggacgtagatcggcataatgtcaatcgggacttcacgttgcagggtctgtccgccttccagtgtttgcccggtccagaagtcgatccagcgggtaccttggggaaggtaaacatcggtctttccgattttgctcatgtctttctgatgaccgttttgcttcttgtcttgccatgtatacaatgaatccgtcaccgggcgaaccaggaagttgcgtccgaacatatattcggtgtccatatcgagcactttcttgtctttcgggaagtccatcatgagagggcgcatgatactgcctgctttgctggtcacttcccaggaagtgctgtagatgtatggcaacaggcggtaacgtaagtgagtgtatttctccagtgcatcgtatgaccagtcgcctttcttgccgaactggtagatttctacggctaccggactggaattgtgtgaacgcatgatcggctggaatactccccactgataccagcggacgtgcagttcatgataggcgatgttgtttacgttattgttatatctccatgcgaagaagccacctaggtctgtgttccagtacgggatgccgcataacgcatagttcagtcctgccgctagttgcttgcgcatgacggaccattcggaagttacgtctccgctccatgaatgggaagcataccgttgctgtccgaggaaggaggaacgggtaagcaggaatacgcgcttgtcggaagtagtggcgcgttggtgttcatatacgcctttgttggacattaaggggaaggcgttgtgtaccctgcggaaagaacccagataggtctgcgtgttgaagtcctggtctttgatatccatgtggtccggttcggtggagtcgagccaccaggcatccatacccaggtcgaagatgttctttttcattgcttcccagtagatgtcccgtgctgccggattatacgggtcgtaaggtttgactccggctttgggcggccacgtttcgaaatggagcagtgctttcagactgtccatcttctgatacatttctgtccacggaccgaaggaggcccatacggagatcatgatgtgggcgttctgcttgtgcacgtagtcgatcatttctttggggcttttgatgcggggagtgccgtagtcggcattcttgtcttctccgttcgggaggaatttcatgtattccgggtcacccatcttgttgatgtagcgtggattctggaatttcatggagttccagttctcgttgcagccccagtattgccagtcttggatgattccatccaaaggaactttcagttcccggtatttgtctacgacttcgcacagttcgtccggacttttgtagcgttcacggcattgccagaagcccagtgtccagagaggatacaacggggcttgtccggtcaggtcgcgtactccggctatgactccgtcggcgttgccgccgtagatgaggtagtagtcggcacagtcgcctacttccgagtcgaaggaggtttcctgcggattgtcgaggaaggtggtaggggagtaattgtcccagtagagggcatagcctttgatggagtggatgaaggggatacagatactcatgttctggttgcggagaaagagtttctgattgcgttggttcactttgccggtctgctgttggcccagaccgtagattacttcgtccttatccagcaggaaagcctgacggacattgtaggaagggacgcccgcgtcattgaaaggggtaaactgtgtaccgtagtctttgtcggtcagcagcagttgccctagcttgtcgaagaagtggatgccgcctgtttcggggttcacttccacttgtatcatctgactgctcaatgttacatttttcccgttttcaccgaaagaaaccggggtttgttccggtgctttgatgacaacgaggctttctttgtcggaagccgtttcgctgggcgttttatatacccggacgatggaaggcgaataaaattctacactgacgttcatcccttgtgctgcatacttgatgccttgggaagtacgttgtacgttttgtgccgtaccgttagcggcaatgatcatggcccatgccaacaggatgcctgtttttcttagattcattttcatggtttctttaagtgctttatgatacggcaaaggtaggatggaaggacgttttgcggacaatagctatgttgaaacaaacaacaatcaggttgatttcttcgctttctccgtatattccgagggacggcatccatacatttcttgaaaacatttgcttaggtagctggaactgctgaagccggtacgttccgctatttcggttacgctcagtttgccttcggcaagtagttgcgctgcccgttggaggcggatgttgcggataaagaggctgggggactggtcgagcaaagtcaccagtttgcggtagagtccggtgcgttccatgcagaggtcacggcttagttgctctacggagtagccgttgacgtcaaggttcttttctaccagttctatcgcttgcactaaaaaggcggattctgcactgtccggttctatgccgtttggcttttcattatcatctgccgtttcgttcctgtcgcagacggaagggtggcttttcttctccgaacgagctttctgttcggcttcatagctgttgcattgctctatcaggttgcggatgcggagcagcaggatttcttctttatgttgctgtttcatctttttcttggtctgatagatatagaggcggatgcttgctaagacaatcagtaacacgatgatcgtatacagaacgtaggcggtagtcgttttccaccagggagcgtggatgatgacgtgtatctttgtgatgttatcgttccattgtaactggttgtcggatgcagcgactttgaatgtatattctcccggcggtaaattggtataggaggcctgtaggatgccgttgccgactgttgcattcccttgtccgctggcgaaagcgttcatccattgtttgtcgatgccttccagttggtagcggtagtaggtgcgttcgctgttcacgtagttcagtgccgaacattcgaaggtcagaaagttctggttatagtccagttctagctcctttgtgtaaggggcggcttgtggcaggatgatgcggtttccgtacttttctcccgtgtttactttttcaccgtagagatgtaagttggtgaaaaccggtttgtaaggcaggcccggagtggcggattcatggtcgggacggaaaatggtaaagccgtcgatgcctccgaaatagagtgtaccatccgaagattcaaagatagctccctgtatatattcctcttctaaagccccgtccagttgattgaagttggtaaagccgatttcctgattctccggattgatatggatgcgtgaaatgccattgctggtagttacccagatatagttgtttctgtcttcgatgattgattgtacgaagttattgctcagtccgtcttcacgatagaaaatgcggtgggcttgggtattggatgaggcggggtgattatctgctgtttgtgtggtcggtttgctatccggtgtttgctcttgatcggtgaagagttccagtccgtcggctgtccctgcccatgtccagccacgtgtgtcggtgcatagagcggtgtatgattgccttctgtaatatttgtttccacctctttgatctaattcctttgccaattctgcagagaccgatgaggctggtacaggcagcagagtccgtgaaccgtcctgattgacagctagctgatagattgtggaatggcttttcagatagatattgccgttatcatcttctgcaaaagctttgacggcaatgtcctcttccggtgatgcggggaaagcagtgcggctgacgtgaatcagtttgtgtgtggcaggatgatgatagagtaatccccgattgagtgtgccgacccataacccgccttgggcatcctgaaagatggtgctgacttcggtcgaaacgagctttcccttctttgtttccagtacggggatgtattgctgttccctgctttcgaggtcgatgatccagaaaccgtggacacaactgatatatgctttatcgccctgtggagtgatgatcagggtgttgagcgtgtagttctgttcgaacagcttttcccatgtccggttttggggattaaagtagaagaatcctcctttgcggccgttgcgtaactggtagaatccttttttgcttttgacaacgagagaagtacggttgaagttctcctgttcggaggcgggataagcagctctgtcatacaactgtttcccggttttcgggtcgtagcaaacgacttcaccggtatgatagaataggtaaaccgcaagttcatccgaatgtatgtcctgtagctttcgatgttcattctccggcagggtgagacggatgcctgtttccagttcccgcaactcttgggaagtaagtagccagatacgtcccgaattgtcgacgaaaaggtcttctaccggttcgtgtatctcttttctgcggaaataggagtcaaggtgaggtatgtatttttcttgatggagatcgatgcacatcagtttatgataatctttaatccataggagtgaatctccgcattgatagatgcggtaacatccttcatactgtttcagcggggaaacgtcttctgccgtgcggtgaaggtagctgaaatgtacgccgtcatacagattgacattcccgttggtggtgaataccattcttccgtcggggagttggagtatgtagcgtatttggttgtcgctcaatccttgtgccgtgttgatcgatgtaaacaggaagtcgttggcgtccaccgtcagtgtcatcctgatacacaggaggaggaatagtagtattcgggtgtttttctggttatttgccgccattgggataaggattatgatgttcgatgatgcaaagataaaaaaagtcggggttatacttggataaactgttctttttgtaaagggtttcgggagggaatgtctgcatatcaatcaaaaaaggggggaaatcatgcaaacgatgaaagtttgtatgcgaatataattatattctctatttttgcttttgttacaatgaggacatttaatcataaaagaaaaataatattatgaagaaacttgtaagcactttgacagcgattcttggtataagcactcttgcagcacaggatgtggttgtaaaaggaccggacgaaaagttgcagttggcggtatttgtgcaaaacgagacgaagccttgttattctgtgagttacaacggaaagacgatgttggaaaagtctcctttaggcatgaataccaatatcggtgattttacgaagaatcttaaactgaccggacattccgtcgacaagatcgatactgtttatcaacagacacgtatcaaagtttccaacgtacattaccgtgccaatgaactgacttgtcatttagagaatgagcagggacaaaagctgggagttatttttcgggtgagtgataatgatgtggctttccgctatactttgccgcatcagggaggaaaagcgagtgtgacggtgaaggaagaacaaacaggtttccgctttccggagcagactactactttcttgtgtccgcagagcgatgcgatgattggctggaaacgtacgaaacccagttatgaagaagaatataaagcggatgcgccgatgagcgaccgttcgcagtacggacatgggtatacgttcccttgtttgtttcgtataggaaatgacggttgggtgctggtcagcgagacgggtgtggacagtcgttattgcggttcacgtttgagtgatgtgagtgaagggaatttatatacggtcgcctttccgatggcggaagaaaataatggaaacggaacggtcgctcctgcttttgcactgcccggcgctactccgtggcgtaccatcacagtgggagatcatctgaagccgattgtagaaacaaccgttccgtgggatgtggtaagcccgctttatgaaacaaaacatgattatcgtttcgggcgtggcacgtggagctggattctttggcaggacggcagtatcaactatgatgatcaggtacgttacattgattttgcttcggctatgggatatgagtatgcgttgatcgataactggtgggatactagaatcgggcatcagcgtatgaagtcgctggttgagtatgcacgcgataaaggtgtcgagttgttcttgtggtatagttcttccggctattggaatgacattgaacagggaccggtgaaccgaatggataatgcaatcattcgtaaacgtgaaatgaaatggctgcaaagtctcggtgtgaagggaatcaaggttgatttcttcggcggtgacaagcaggagacaatgcggctgtatgaagatattctgagtgatgcggacgatcacggattgatggtgattttccacggttgcacattacctcgcggatgggagcgtatgtatccgaattatgtgggcagtgaagcagtgctggcttcggaaaatatggtgttcaatcagcatttctgtgatgaggaagcgttcaatacttgcctgcatccgtttatccgcaatacggtgggatcgatggagtttggcggctgctttctgaataagcgcctgaaccgtaataacgacggcggtacaacacgccggactacggacgtgttccagttggcgactaccgttctgttgcagaatccggttcaaaactttgcactggctcctaacaatctgaaagatgttccggctgtttgcatggactttatgaagcgggtgcccacaacgtgggatgagacacggtttgtcgatggctatccggggaagtatgtggtgttggcccgtcgtcagggagatacctggtatctggcagctgtaaatgccggcaaagaaccgctgaaactaaaactggatttggaaatgtttgccggaaagacggtggctctttataaggatgataaaaagggagaaccggagttaacgtcactgaaagtgaaggaaaacggtaaggtgcagttggaaatccgccctcaaggaggtattctttgtataaagtagcctgtcaatatggtttatttgtaaatgctgttactttaaatatcggtattgtcttatcgtaaatcgtatttatcctattaaacttaccagaaaaaaagtacgtttgcattgtcttattcaactgtaatttttgtatgaatcaggcattaactttggataatagataatagtatgcaaaaacagatcttttttagttttgtgctggtaatgatgttggtagggaaagtgaaagctcagcacaataatccttttggcaatgcattgattccggatatgattgccgatgcgagtattcaggaaattaatggtgtcttttattgctatgccactactgatggctatgggcagggacttaaaacatcaggccctccggtagtatggaaatcaaaagactttgtacactggagttttgatggaacttacttcccttcggctgcaaaggagaagtattgggctcccagtaaagcaatttttgctaatggtaaatattatatatatcccactatcaatgggtatatgtatcctgctgtagctgataagcctgaaggaccgtttaaactggcacgtgggaaagacgaattctataagccttttactccttctactttattgcagagtaagaatccgggcgggattgatgctgaaatctttgttgacgacgatgggcaggcttatgtgttttggggacgaaggcatgtagccaaactcaacgaggatatgattacggtggattctgtagtacaggtaatttctactcctcgcaaggagtactctgagggacctatctttttcaaacgtaaaggaatatattattatttgtacactatcggaggggatgagaaatatcaatatgcgtatgtaatgagccgggtttcccctatgggaccttttgaagctcctgaacaggatataatatctactaccaattatgaacggggaatcttcggaccgggacatggttgtgtctttcatcctgagggtacggataattattatttcgcatatttagagtttggcaggcgaagtacaaaccgtcagacatatgtgaatcaactgaaatttaatgaagacggtacgattcgccctgtcgaactaacaatggatggagtgggggcattgaagaaggtgaaatcagataaaaaaatgaaaatagatacagtttatgcgtctagtattgaagtgccgttgaagattgaaccgatgaaagacccgacatgtctgcggacagaatattttgttccttcttttgcggtggacggagcaaatggttcccgatggatggctgctgccgaagatagtattaatccatggattgtggcagatttgggtactgtaaagaaggtcagacgcagtgaaatttattttgtacgccctactgccggacatgcttatgttattgaagcatcgatggatggaaaagtctggcaagagttcgctgtccatcaagataggaagatgtgttcaccacataccgatgtcttgaataaaaggttccgttatctgagaattaaaatcctaaaaggagtccccggtatctgggaatggaatatttattaataagccaaaagtgtatgaatataaaaatgaatatgaaagtccccacatgtattgtagtattgatttttactttgtcaacagtaaatgtatttgcacagaatgattacaagtgaggagaatggacaacttggggcgatcagggagatggcacctattgtaatcctgtccttccttccgattacagtgacattgattgtattcgtgtgggggatgattattatgctatttcttctacctttcaatattccccaggtatggtgatcatacattccaaggatttggtgaactggacgattaaaggtcatgtggtttctgatctgagacagatcagtgaagaaatgaactggacgcgtatgaatcgttatggccgaggtatttgggcaggggcaattcgttattatcagggaaaattctatgtgtatttcggtacaccggatgaaggttattttatgtcgacagctaccgatcctgcgggaccgtgggaaccgttgcactgtgtaaaagcagaaaagggatgggatgactgttgtcctttctttgacgatgacgggcaactatattttgtaggtacccattttgctgataaatacaaaacttacctgtaccggatgacacctgatgggaagaccttgatcgaaaactctaaaatattaattaatgaggggtatggtcgcgaggcaagtaaactttataaaatcaacggaacatattatcattttttcagtgaagttaaaaatggcggtagatatatcatgatgcaacgttcttcttcaattacaggaccgtatcttgaaaggaaacaattaagtcatgtacagcgtgaatataatgagcctaatcaaggcggacttgttgaaggtcctgacaggaagtggtatttttttacccaccatggtacgggtgactgggcaggtcggattgctagtctgctaccggtatattgggtcgatggttggccgattattggtgaggttgggcaggatggcattggcacaatggtatggcaagcggccaagccttccaatgagtatccggttcggactccacaatcatctgatgattttagcaagtcggtactttctcctcaatgggaatggaactaccagccccgggacgagatgtggtcattaacggaaagaccaggcaatttgcggttaaaagcttttcgtccattagtcacggataatttgctgaaagcgggaaataccttgactcagcgttgttttcgtacaaacaaaaatgaggttattgtaaaaatgaacattgagggcatggttgacggacagaaagccggactgtgtcattactctaagagttatgccatggtgggggtacgccagtccggcaaagaccggaatctggaatttcagaccaataaagagaaaatcacaggtcctgcgataaagggaaacaaggtgtggattaaatctgtatgggggctggatggaaaaagccaattttcatatagtacagatggcaggaagtttaccccgttcggagaggtatatcaacttgaatggggatattaccggggaagccgcattgggatttactgttttaataatatagcggatgcggggtatatcgatgtggatgagtttatttatttatattaactgtttagtgtatgaaacattcctttaattgtttaagttatgaattactgctttatgtgctcatttgtattccattctgttcttgttctcaaaaagatacaggtgtgatttctcctaatgggaagatatgtctttctgttgaaataaaggaagatactgaaaaagacggttttggcaaagtcttttttaatgtagagtacaaagatggtaaaacttccagaagggttctatctgatacccgaattggcttggaaacccagcttatgtcatttaccgataacatcaggttgaaatctgtgtccggtactaaactaattgaagatgattatgtgatgcttaccggtaaaagaagtcattgtcagaatagaggaaatgaaaggatatttcggtttgagaatgagaaggcagaaaccttagatatcgttttcagggcttacgatgacgggattgtatttcgatatagcttaccatctgttcaagataaggatagtctgacatctgaacatacagcttactatattccagaaggaacgaaaagatggatacagaattattctgttggttatgaaggtttctatccattgaaaaccagagcagaaagaggcaaagacaatatgtggggctatccattacttttggaaccagccgattcattgtttgtgttgataactgaggccaatatacttcgtggacatagtggttccagattgtataatggaaatgatatgaatcaatatcaagtgcggatgacagatgataaattagccttgggtgattcattcacatcgccatggagagttcttatgataggttctttgtctgatattgtagaatctactttggtaacagatgtctctgaacctaacaaaatttctgatacaagttggattatgccgggctctgcatcatgggtatactgggcgcataatcatggttccaaaaatttcaagattgtaaaagactacattgacttggctgttgatatgaagtggccatatagtctgatagatgcggaatggaatgaaatgtcaaacggtggagatattgaagatttgataacctattctcttagtcgaaatataaagcctatgatttggtataattcgtcaactgcttggatggggccgggtcctctttaccgcttgaatagtaaggaaaacagaataaaggaatatacttggcttcaaaagtcaggtgtagtaggggttaagattgatttttttcctgatgattattcgtctaatatggattattatattgatttgctggaagatgcagctaaatataaattaatggtcaattttcatggagctactattcctcgtggatggcaaaggacttatcctcatctgatgactatggaagccgtttatggggcagagtggtataacaataagccaatacttacagatcgtgctgctgaacataatgtaacattgccatttaccagaaatgtcattggctcaatggattatacacctggtacattctctgattcccaacatcctcatatcactacttgtgggcatgaactagctttgtctgttgtgtttgagtcagcattgcagcatatgcctgataggccggaggtgtacagttcattacctcgaaaagtaagagaattcctttcgggattacctactgcttgggatgatacaaaactgttgtgtggctatccgggtgctgacatcgtactggcacgacgtaagggagatgtatggtatattggaggattgaacggaactaacgagaataaaactctttctttttcattggttcctctgcaagttgaaggaaaaacgatggatgtatttaaggatggggtggacgataagagttttgccatcgaagaagacatccagttatcaaacgataaaatggatatgtcatgtcttcctcgtggaggatttgtggcagtaataaagtaaggataataaatgatattgttttaaaagtcgatattgttttattgtaaatcgtattcatcctattttttttcactaaaaaagcgctacgtttgcattatataattcaatcgtaatatttatgaaagcaaaaaaattactattactatccttgttatttatagcggagactttatctgctcaaaactatcaggttcctgtttcggagcaagatgaacctatgatgcaagggaaattccagcctacttgggaatcattggctaattataaaataccggaatggtttagaaatgtaaagtttggcatttgggctcattggggcccccaatgtgtggaaggatctggcgattggatggctcgttctttgtatatggaaaattcgcctgaatatcgacatcatatagcgaactacggtcatccttctgaatttggctttaaagatattattccgttatggaaggctgaaaaatgggaccccgataagttggttgcattttataaaaaaataggtgctcagtatttttttgctttgggtaaccatcatgataatatggacctttgggatagtaagtatcaaccatggaactcggttaatatggggcctaaaaaagatatattgaaaggatgggaaagagcagcgcgtaaacatggactttattttggggtcagtctgcatgcagaccatgcctggagttggtatgagacttcccaaagacacgatactcaaggtcctaaaaaaggtattccgtatgatgggaaattaacgaaagctgatggaaaaggaaagtggtgggaaggatatgatcctcaggacttgtatgctcagaatcatccgttaagtcaggatagttgggataatggtacaattcataggcaatgggcatggggaaatggagtttgtttaccaacacaggaatattgcactaatttctataatcgtacacttgatgtaataaaccgttataatccggatttgttgtattttgatgtaactgttgcacctttttatcctataagtgatgcaggcttaaaaattgcggctcatttttataatcataatatgtcaatgcaaaagggtaaattgaatgccgtaatgtttggtaagattcttgatgcaaatcaacgtaaagctttggtatgggacgtagaacgtggagctcctaataaaataatagatgaaccttggcagtcatgttcgtgccttggcgggtggcattataatacgtctatttataataataatcaatataagtcggcagctgacgtagtgaagctgttagttgatattgtcagtaaaaatggtaacttacttctgagtgtcccgttgcgtgcagatggtacatttgatgaaaaagaagaaaagatattgaatgaatttggtaattggatgaatatcaataaggaagcaatctatcaaacgcgtccatggaaaatatttggtgagggacctatagcggataaagatgttcaactcaacgcccaggggtttaacgaatgggcctatagtaaagctgatgcaaaggaaatacgttttacacaaacagataaaaatttgtatgctacagttttaggatggcctgaagatgggaaaatcttaattaggtctttagcggaaggtaacgggttatatcccactaaaataggcagagtagagttgcttggttacggaaaagtatcttttacacgtactgataagggacttgttgttgatatacccgctaaatcgttgaagaatatagcccctgtcttgaaaattagaaaataaaagttattactatgtcgtctattcagggatacaaaatgaaagagtatagcatgcctacaaagaggtattgccaaactttaagccttaaaaataatccgattctgattgaagagtatcgtaagatacatagtgaagaaaaggcatggccggaaataagggcggggatacgtgcagtagggattctggaaatggaaatttatatattgggatcacaactttttatgattatagaaactccactggactttgattgggagatagctatggataaactgtctaatcttccgcggcaggctgagtgggaaaagtatgtgtctaaatttcaagactgtccgtatttgagttcttctgctgaaaaatggaagttgatggaacgtatgttttatctgtatgaagattagttgaggataacgtaatcgtttactacgtgttgagaaaaaaggaatagtgtgaaagttgctattcctttttttctgcttaagagtgataagaggtgcgatattcttggggagtaatacctgtgatttttttgaataacctgttgaagtatgaataatcttcaaaagcaagatttaatgcaacatttttgattgacatatcatcggttattagtatgagttgagctttttctattttcttacggttaatgtattttaagggggtatctcctgtctcttttttgaatagacgaataaaatggtcttttgataaacaggaattctcagcgagtactcttaaatcaatagtttcatttatatgtttacggatatagtgaatggcttcttctatccgattgtcttttaattccatttttacttgagctctttttaggaaacgtgctagcaattgatatacaatacctcttgattctatcttatcagacaaggtccgttgtttgttttttagcagattctgcataagggtgtaattgttatcgtaagaagtcgggtctgatttctgtaaggtcatatgtggatttatagtgcagagccgctgaaataatgccaaatctatttcgacagcggggatttctattggaaaatcccaattgtccagtaagttgctgtctgactggtgttcttcatatatatgcagataatagtgggaaaaataagagttgcagatatagctatgtttggtaaaagctggaataaaatacatgtggttagcttttagaatctgagttttacccgatattaagacttgtgcagtaccttctgtcacataatataaacgtgtaaaagggctattgacatttttccagttccaatcggcattatgaatagccaaacctatgttcaaaacaagcgggtgcaatttatcaacaaatgaagccatagcatatagggtttattaatgtgaagataaagatatataaaaaataaatataactcttttgatgtcgataattttaaataatatatcgatattgttttataataaatcctgctatagtcgttcatgtcgatattgtattactctaaatcgtattagtcctacaatgtggactgccgagttgttacatttgcggtatataatctaataggaatatttatgaaaagtatgagaaaaaacacatggcttcctcttattggactccgaacttttctttttgtgaccacagcgtttacaattgtttcatgcagcgatgacaaaggagaagacgggtataaccctaatcttccggtcagaattagcgaattgtctccccaggaaggcggatactttgataaagtaatcctccagggtgaaaactttggcaacaaccctaaaaaggtacgtgtattctttaataaaaaagaagcgattgttgtaggagcatccggcgatcgggtgctggttcatgtcccgaaactcccgggcgatgattgtaagataggtatgcttttaaacggtaacaccaccgatactattttcgcagaaaagcatttcgcctatgaaaagaattatcagttgatatatgtagccggacagctcaactccaatacagaaacatttgtagaaggaagcttggaaaccacaacatttgccaatagtatgcagcatctagcgtgcgatcccagtagcgtcatatatatgaaccataaaaatacaggtcaaagtggcagtcttatttacattaatgaacctgagaactactctaagtttttggattatggagcatctactgaaaacggaggctcgcctagcactccgtattatgatgacaaaacagagaaggtttacttctgtgcgcaccatgctccatttttttgggaagttgatcctaaggattcatggtcttttgtgaaaaggaagttgattgcccccgacgccagttaccaggcaaaaggatatcgtcccgtaccaagcggtcagaagttggagtatatgtgttcctatgctcgtgcaacagatgctaatggcgaaagttttatctattgccggacgtggcaaggtcaattcttccgtttcaaacttgaagatcgtgtctacgattatgtcaccacttttgccaaatcagatgcatgtctggctacagaccccgacgacccgaccaagatttactgtgccttgaatgaatacaacaaaataacctgcattgatttgacaaagaatccggaagacagcggctttgagacagatgtctgcggcatacagggaccaggagcatatcaagatggacacgtttctgtggcaagattgaacaatcctcaacagattttgtcaatgcacgaccctgaaaccggagaaaaggtgatatacatctgtgatgccaacaataactgtgtacgtatgtacaatatggagacaaaattgatgagtaccgtagcaggaataggcgggaaatccggatatgctgccggaaatcctacagtttcaagaatgaacagaccttatggtatctgtataactcccgaaaatgacatttacgttgcagatgcaggcaataaagtaataatgaaactggcatttatgtaatgatgagtagtaatcgtttaaagaagaaaaaaatgaaagcttatataacaaatagaatatatcttatgctgtttttctgctccattaccataatggcacaagcacagcaaaagtttgagatatccggtatagtccaagatgaaacaggacagcctgtcccgggagtcagcgtatatgtaaaagataaaacaggcataggtacgaacaccgatatggatggaaaatttgttttgaaagtcgatcgtggagataaagtgcagttcagttttataggatataccagacacgagtatctagcattaaaaactgaaaaaaaactggttatccaattagtaccggatgtaagtgcacttgatgaagtggtagtagaagcttatggaagcaagactcgtaaaataacaacgacaggtgctgtcacttccgtagacgtagcgacattacagactcctgccaccagtctggctaatatgctgggaggacgagttgccggtattatctcgacacaaggcagtggcgaaccgggtaaaaatatctcagatttctggatacgcggtatcggaacatttggagcaaacgcatcagcacttgtcctcattgacggtctggaaggtagcctgaatgatgtagacccggctgatattgaaagtttctccgtattaaaagatgcttcggcaacagccatgtatggagtacggggggcaaatggcgtagtacttgttaccaccaaaagaggaaaacaagaaaagttaagctttactgcacgtgcaaatgctactatttcatggctaaagcgcctaccggaatattgcgacggatataactatgcaaaattggcgaatgaagcactcgttgtacgtggcgatgaccctaaatatacgaatcaggaactggatatcattaaatacggcctggatacggatttatatccggatgtcaattggcaggatgaagttctcaaaaggtcttattggcaacaaacctattatttgagtgcccggggcggtggtagtatagcacgatactttatcagcttaaatggttctaacgagacttctgcttaccaacaggataaatccagtaagtattttaaaggtttggcatataataccttcgggctacgtgctaatattgatatagatttaactaaaactaccaaattatattttggtgtcaatgccaataagacaatcagaaacctgccgggtgccgcagatactaatctgatctggtctgcttgcagcaaactgactccggttaccataccagtggtttactctaacggaatgcttccttcagccaatggagtgacagatgaaatgtccccttatgtacttctgaaccacacaggattgaaacaagaagaagaattcacttctacttatacattaagtttagatcaggacctgggtatgctgattaaaggattgaagctgaatatacaaggagcctataccaacgacaacgcttttcatgaaacacgctacatcatccccgaactgtggtcatatgataagcgtaatgcaactggagaactcgcaggaaaacgccagaccgaacgcataacgacccagtacagtaaatgggaaatgcaataccgcaaatacttccttcaggctaccatgaactgggcacatgatttaggacacggacacacgcttacggcactggcgcattatgaaatgagtgatcaaaagcggtcaactgatgccaatgacacgatgtcggctattccagttcgttatcaaggactttccgctaaagtcggctacaattataatgatacatatatagtcgacggcaacttcggttatacaggttccgagaatttccagccaggacgccagttcggattctttccatccatatctggtgcatgggtaccgagtagttatcaatggacaaaagataaaatgccatggttgaactattttaaaatccgcgcttcatacggtttagttggtaacgaccgtatcaccgacaagcgttttccatatctgaccagcataaatgtaaatggttccgctaccacaaactggaagtataccaagggaggtatttgggaaaactcgatcggggcagataatctggagtgggaaaaagcaaagaagtttgacgtcggtctggaaggtaaattattcgataaatttgagtttgtaatagacttcttccgggatactcgcgacggaattttccaagaacgcaaacaagttcctgattttgtaggactcgtaaatatgccattcggtaatgtgggcagtatggtaagctggggtagcgacggcaatatcaccttcaaccaacgcatcaataaagacatggaattcacgcttcgtgctaatttcacatactctaccaataaggtgaactactatgaggaaggagataccaagtatgaatatacatcagcaacaggacgccctaatggctacatgaaaggttatatcgctttaggacttttcaaggaccaagaagagatcaacaatagcccgaaacaagatttcggaagttacctgccgggagatatcaaatataaggatgtaaacggtgacggtgttgttaacagtgacgaccaggtaccagtcagctatcaggattacccgcgtctgatgtatggtttcggaggagaatttcgatggaaaaagctgacattgggcgtacgtttcagtggaataggtaatacagactattacaaaatatggacatggggaagcaataatgtgggatatattcctttctatgatggtaaactgggcaatgtactcactattgcagccaatcctgccaaccgttggattccggccgattatgacgatcccagcataccagccagtatgagagaaaatcccaatgccatgttcccgcggctaagttacggtagcaatcagaacaatgcgcaggcatctacattctggaaaggcaatcgcaaatatttacggctcgatgaaatcagcctgaactataactgtaactgtaatttattaaaaagtattggaataaattcgatcgatctcgctgtagtagcaaacgatttgcacacttgggacagcgttaaattattcgatccggaactcgccacaagtaatggacgtgcttatccgattccgggccgcgttagtttccaggcaatcgttcatttctaaacatgatcattaaataacaaaattatgaaaaagtatatattacaccgatcaataaacctattcatcgtatttcttgggatacttacgaccggaggattcacctcatgcaattttttaagagtcgacgactattttgacgatacaatgaagtttgacagtatctttactaaatacgagtatctggtacaatatatgtggggaacatcagatcagttccccgacgagagccgcatccttaccgatccggtcactcccggtccgatggctacggatgaagctttctcaagtcagaatccggagcatggccttcgcggactctcctacattctgggaactattaatgccgataacatcggtaactatagcatgaatatatggtcgtccatgtataaagtgatccgtaaatgtaactacatactggcacgcaaaggagaggctcacatgaatacaatacaagatgaggaaatcactggctacacccacatgatgcgtggttatgcttattacaatctgatccagtcttatggtccgtgcattatactcggtgatgatatcttacccaataatgaattacctgaaacttacaattattcccgttcgacttatgacgaatgtgtggattactgttgtaatgaactggaacttgctgccaaatatatgcctatagacttaaatccgactttttttggacgtccttcacgtggtgctgcttttgcgttgatagctcgtctgcggttgcaacaagcaagtccgttatataatggcggacaggccgcacgcacagctttcggcaactggaagcggacagtggacggagccaactatgtgaatcagaactacgatgaaacacgctgggcagtagcagctgcagcatgtaaacgtgtcattgagatgaacaaatacaaattgcatacttctcccatcgatcccagcatgcctccccgagtattgccggcttccgtgacaatcactgaccccgattttcagaatatcgactattatcgttcctattcagaaatgttcaccggagaaacgataggcagtaaaaatccagaatttatctggggtagacagtcggatgctatggcaaacatgacacaatgcagtttcccgacggaaaaagcaatggggggatggaacaacctctgcgttactcaaaaactggtagacgcttattatatggtggatggacgagataaaaatgatgcaagtaaagaatatccatatcatgtagcaaacggtacagtgaccgatgattacttttccaccagtgcagaggagttctccggctacactattccgatgggagtatacggtatgtatctgaaccgagagaatcgtttttatgctacaataggttactccggacgttactgggcagcacgttccaatacccaagaacaatatggcccttatagggcgtggtatcatcaaatggtaacttcaggacgcgatctgttttccgggaaaaattccgccataaccaatcctctggattatccggcaacaggatatgtgctgactaaatggatccatgcggacgacgcatggataggaaccggaagtatgcgaactaccaaatattttcctatcatccgatatgcggaaattttattaggatatgtagaagcaataaatcacctgagtaaaagctataccgtcgaattacccgcaatcaatggtggaaataatgctccgcaaagctatacagtcgaacgtattccaactgaaatacaaaaatacttcaacccgatacgaaatcgcgtcggtctgcctggattatctgacacagaagccgcatcagatgaaacaactttggacaacatcatcaagagagaatatatgatcgaattcgcttgcgaaaaccgcagatactttgatgtacgtcggtggggcatatatgaagagactgaaaaaactggtgtttatggaatgcgtttgggaggagataaatatacttattatcagaatccgattcctgtgaatcaggttaacaaccgaaatcgcgtgatagataaaagactgattctattacccttgcccaaagctgaagtacgtcgtgtagaaaatctcgaccaaaacccgggctgggagaattaataatttacttcgtattaaaacataaataaccatgaaaacaaaatatatttatatagcttttttaacaatcttatgtgggggaagcttggtggcatgctccaatggcgacgagttcttcaaggatgaacgctacaagaagatgatctatgcaatcagcgacaatgagcaaatatttcacgctgaatttgaactgaataatgaagaagatatcataggcgtgcagcctttcgcagtaagcggcactaatcctatagatcaggatgtgcatctgaacatagaaaaagatccggagctgttgacggaatataactataatacctacatggatgaaacagataaatatgcccgtgagctgaaggacggggattattcacttttatcttctatcgttgaaataaaagcaggagtgaaccccagctatgaagtgggaaaattacaagtgaaaataaagacatcgatcattgaaaaactatccgttgactctgcttactttctttcgttccgcattaaagaggcaacaccttacgaaatcaatgaagaaaaaaggaatgtattattccgaatttataaaaagaatcagtatgcatcccaaaagacacccacttactatgcctcttccggctttatggatgatgtcgtaatgccgttcgactctaaaattatcatgccattggcatataataagatacgcacttacattgccggacaaatttacgatgcgaatgataccaaagaaacaatcaacaaaaattcgatggtaatcactgtagatgccgataaccaagtgctgatatctgctttcgattctgagaatggattaaaagttgaaatgttatctccaagttctgatcccaatgatggctcatatggatatcggaactattataatccagaagaaaagcaattttacttatattatcgttttgataatggtgaaggctggaaggttgtgcgtgaaactttaagagccgaatctatcataagtaaatagtgattggcgactatagatattttttcattatgcgaaaagaaacagacgaatattgctgtgttttaataaaaatacactatattgcggtattgtttaaccttaaaatatgatagccatgaacacaaaattattcggtttgtttatcgcattgttggtatgcctgccttcgcttgcccaacaaaagcctgtagagaaggtagatagtgatggagtttatctgatgcccgatcaaatgccggagtttccgggtgggatgcaggcgatgatgaagtttttgactacaaatattaagtatcctgtagaagcacagaagaaaggcgtttccggtcgtgtgatcgtacagtttgtcataatggaagacggaacattggatcaggctaaagttgtaagaggaatcgatcccttgctggacgaagaagccttgcgcgtagtgaaattaatgccgaaatggaaaccgggaatggatagaggcgaggcagtgaaagtacgttttacagctccgataatgtttaatctgtccagaccggaggcacagagacctactttccccgaacttgtagtacctatcgggcaggaagtagaaaacaggtctttgcaaggagtatggcagagttgtgttgtgcaaccgggcgaacatggatataaaattctgttattgcctgttataaagatcatatcgcctgatcagacattcatgaatataatgacagccggtatgaacggcaggtcaaatgccatcatctattgtcagggagagtacagtttgccatcggatggcacttacgtggagatggtggaaaaatcggttgatccggtttttatacaaggagtaaagaatgaaatcagtgtggaacgattgcatgataatctgattaagttgtcttttacggttccgggacagggaagaaaagtgacggaatattggttccgggccccttcgccggatgtgaagataatggctaattgatattttaggcacggatttcacggattacacggtcttaatgaataaaagccgtgttcatccgtgaaatccgtgcctaaaaagctctctgtactttcttatcttcgactcagcttattattaattcttaaagaatccgttatcttcccattgtcccgctttctgtggctgtgccgacgtggcgcttacatcgataggcagccatacttccatgtcgccttcgccccgatgtgcccaggcataatagggtatcaatgtgagttctacgtctttagttaccagttttcctgctttgtcataacttaatgcctgcgcatcggtcgttatctgacggatgccgtaaagtaactccggtttgtctgttaccttgaattgcggatgttggttgagaagtatgctgtggacgttgaatctgttgtccggccattctgcgcaataaacgatggggccgcgttcaacggcaacacgtccgtgatcggcttctactttgggatttgcctttactattcgggggatcatgtcgaaatgtacttctaccacatctccctttttccatttgcgggcgatgctgaggtagccatcattgacatcgctttctactgtctgtccgtttacggctacttggtaggcaggtttctgattgtcggcgtaagaatacaggtcaccgggaagtacattgccacgtacccagccggggatacggagtttcatggtgaagtcctgattgccctgcgttattttcaggcggatgtccccattccagggatagccggtttcttgttccagcagaatctttttcttgtctacctttagctcggctttgttggaaagataaaggttcacgtatacctgatcgttcttcacggcatacacatatcccggtaatgacggaatgaaacggctgacgtttgaagggcagcaggcgcagccgaaccaaggtttgcggctgtattttccgttagaagacagcgggttggggtagaagaaagaacctccgtccagtgatacacccgatatcagaccgttgtatagtgtgcgttccaggacatcgaaatatttggcgtctccgtgcagcaggaaaagacggtagttcatgtatacattgccgatagcggcgcaggtttcacaataagcggacaggttaggcagctcgtagttgttgccgaatgcttcgcctgcatggtgtgcaccgatgcctccggttatataaatctttttagaaacgatgttgtcccaaatcttgtctatcgctttgatgtagctgctgtctccggtgatggctgccacatctgccatgccggagtacatatatacggcacgtacggcatgtcctacggcttcatcctgttctaccacaggtttgtgtgcctgactataggcgtctttccggctggtatatccacgggtatccaggaagaactttgcctgatcaagatactttttgtctcccgtcaccatgtatagtttgactaaagccatttcggctatctgatgccccggtacgtatttcttctgttgagggccgttgccgatttcgcggcagacacagtcggcatatttaatggcaatattgaggaagtttcgttttccggtagcttgataatgtgctacagctccttctatcatgtgcccgagattgtagaactcatgacttaggttctctaccgctacccaacgctcttttcctgcccagttgtgcgggtgcttcggattcatggtgcgggctgtataaaggtaaccgtccggttcctgtgctccggcaacgatgacgagtacgctgtcaatgtacttttgcagtttcttgtccggataggtttgcagagagtaactggctccttctattgttttgtatacatcggtatcgtcgaaagagaagccctctactttgtaggtatcgctgggatgtgctgcctttacaaagttttcgtaacgtcccgtctcttcacatttgctgaatgccagagggatggttacttcacggcttgcttgaaggcgctgtccccaaaagttgtccgtcactttaacggaagtaaaggggacagggtctataggatatccatgatttatttgcgcgctgcctgttatgcagatgcaggtcaggaatgtcgcagtcagaacgtttttcatcttggtattattttagtatgaatctctgttgtggtgttatggtgtcgggattacctgtttgattgttccgtccggattgaattccatccggtcaatacatacttcgcggtgccagcccggtccgtcattcagatggttcttgttgatacggtggtatacgatataccatttgtcttttcccggtacttgcaggatagagttgtgggcaggtccgtagatttcttcttttggattttgaatgagtactatcggggctttggctacttcgatcggaccgagtggtgactgggcggtaccataaacaacgtggtagttgggtgagccggtgtcgtctacagaccagaagaagtagtaaactccttttctataaataacgtaaggagcttcacggtatgcgtaagtctgcaaagtccctcctttgggagttaatactaccgttgtctcttctttgacggacagcatgtcgtcgttgagctcggctcctgccatgtagccgttaccccaatagaggtagcttttgccggatacggggtcggtgaatacatccacatcaatctgctgtccccgtcctgtgggagaagaggtgatgataggtttgcccagatctgtgaaaggtccggtgggggagtcggctacggcaactcctatttgcttgcctttgttggtcgttgggttggcactataataaaagaagtatttatacttcccgtctatcttcttttcttcgatgcagggagcccatgcgtttccgtttgcccaagacacatttttgcccatctccagaatcacagtctcttctttccatgtctttaaattctttgatgaaaagaccttaaaataacttccgccccatcctggaaatccgtcactggtggggtaaatataatagcgttttgtctgatgagaatacagtacttccgggtcggcatggaaccccggtagaatagggttaccggatttcttattttgtgccgttacttgtactgctccgatgagtaataagtggaatagaaagattttggtaaataaatgcttcatgatatttacagttagatttttgttatattataagtacgacaaagataggggatccacctaaataaaaaggttacatatctgtcaaaggagggtaattatcattcataatagagaagatgatctaaatttggactttaatgaacggtattcggatgtccttttgtatctaaagcattatttttgcgctgaatctaaaaaatagttggttaccatgagagcgaagctgattttaccttttctgattttatatttgttctgtcatttgctgtcggtgcaaggacacgaagttgacattgtaaatgccggcagtgataaaaatgtagcatcttctcaagtgtatgaagtaacttccgaaggagcatggtgttggttcgctgatccgcgtgcgttgcattatgagaatgaaaaaggtacaataaacaagacatatgtcggctatattgatatacacggcaatattaaagcgatgcagtatgactttaaaaagaaaagacaggacgaggtactgattcgttcctattttcagccggatgatcacaataatccgacgtttctggtattgccggatgaacggattatgatcttttattcccgtcacacggatgagccttgtttctactatcgtatttcccgccttcccggagatattacgacattgggagaggaaaaggtgattaaaacaaaggacaataccacctatccgtctccgtttatcttatcggatgatccggaacatatctatctctgttggcgggggattggctggcaccctactatcgccaagctgtcgttgcccgatcagaatgatcaggtggcggtggaatggggaccgtatcagatagtacagtctaccggtgcccgtccttatgccaagtatatgtcgaatgggaaagataagatttattttgcttatacaaccggtcatccggataatgagaatcctaatttcctctactttaattatatagacattcactctttgcagttgaaggatgttaaggggaatactctttcgactattgctgacggtacttttaaagtgaataagacggatgattatgcgcgtcagtatccatctactctgatagataatccatccgcacgcgattgggtgtggcaggttgcttcggatgagaatgataatccggtcattgcaatggtacgaatcagtagtgataagaattcccatgattactattatgcgaagtggaacggacacgaatggaaaaagacattccttgccaacgccggcggtcattttcaccagacaccaaactcggagaaatgttacagtgccggtatgactatagatccggcgaatacgaatcatgtttattgctcgttgcctgtggaaggaaagcaggggaaggtttacgagatcgtgaaatttatcttgaacgaggtcggggaggtggtctctacagaagcggttacgcaagactcgcagcagaataatgtccgtccttatatagtaccaaattcaaaaaatacgcctttgcggctcacatggatgtatggcaattattacgattggattgtcagttcacggtatccgcaaggctattgcacagggattgcctgtgattttaaaggtttcccgggggcgaagaaggaaaagactgttgtaacggagaaggatttcaagttcaacccgaagaaggcttttgtattggaacaaacggtcactttggatgcagacaattatcaaggctcccttttacaattgggtgatcttcaatattatctgaacggacaaaccatgaaaccggaagttagatataacggaaaggtatatcctagcacaaatatacttggaacatctgattgctggaaaacaacttcgcgcaatacaggcggtgagtggtacactccacaaaagtacgggagtttcaagttgaagctggagtataagaagggagtattatgtgtgtatattaacggattgctggatcaaaaaatagaaatacaatgagaagaaaagttttaagagattgtgtgataggagttcttttattatttgttctcccgttggcagaactgtcgggcgctattgctcaggagagtgtgtttactgtacagcagcctgattttcaaaagagtccttatacgggaatgacacgtcaacactggatacaggcgggagagtatctgctgaaaggagcattcggttatatccatacgttggatgatcagatgtactttccgaagcaactggacaaaacatatcccaataatgacggacaagttccggttgctaagttggaggggctggcacgaaccttatttattgcagcacccctgttgaaagataatccggaactggtaatgaatggaataagagtagcagattactatcggcaccaattagtcggtatctctaatccgaaaagtccgagttttatttctcatcgtaaaggaggacctagccagacgttactggagttaggttctttggccatttcaatgaaagcggctcaggccgttttgtgggacccgctgacaaaagcgcaaaaggattcgcttgctgcaaccatgctgagctacggagaaggaccgaccataggctctaactggatgttctttaatgtctttattttaagttttctgaaagatcagggctatgcagtgaatgagagctatctggagtcgaatttaaagaaactgctggcacgttatcggggggaaggctggtataatgatgctccggcttatgattattacagtgcgtgggcttatcagacatacggccccatttgggcggaaatgtttggaaagaagcaatttccccagttggcacagcagttcctggcaaaccagcatgatatggtagctaactatccatacatgtttagccgggatggtaagatgaatatgtggggacgaagcatctgctatcgttttgcagcgactgccccgttgtctctgtgggaatatgataaaagtggcgatgtaaattatggctggataaggaggattgcttcttctaccttgctgcaatttctggaaaatccgaaattcctggaggaaggagttccaacgatgggattttatggcccgtttgctcccgctgtgcagatttatagttgtcggggtagtgtatactggtgcggaaaagcttttttgagtttgctgttgccggaaaattcagacttctggtctgccaccgaaaataatggtccttgggataaagaactgaaaaaagggaatgtctataataagtttcagccgggaaccaacctgttgattacgaattacccgaatagcggaggcgctgagatgcgctcatggtgccatgaaactgttgcaaaggactggcagaagtttcgtagtacggagaattataacaaattggcttacaatacggaattcccgtggatggcggatggtaagaacggagaaatatccatgaattacggaacaaagaatcagaaaggcgagtgggaagtattacggctttatacgttccaaagttttaaagacggtatctatcgccgtgatgccgtacttgaaacagacagtacagtaagatatcaactggccgatattccgctgccgaatggaatattgagagtggataaagtttcggtctccgaaccgacggaaatctgtttgggacattattccctgcctcgtttgaatggtgtatttaaagaaacatcccggagggtcggcaagctggatattccggttattgataacggagagtatgaactggctatgataccattggctggatgggataaactatatacatcgtatccgaaagggctgcaccctgtcagcgatgagtgtgctttgattatggcttctgataaattggctggcagcaagatttatgtgacgcttcaactttggaagaagaatgaaggtaagaacggctttacaaagaaagagttgaatccggtccgggcgatagatatttcggaagataagaaacaagtgacagtgcgtctggatacgaaagagataaaaacggttctatttgagtaatttagaaatatgagaagtgtgcagtgggaatattttcccactgtattttttatgtataatggtgagccttaaatgcctatatggtgaattttccttcaaaacgttctacttatcagtatatctgtatagctggaactgtctaatcgttgtttattaaattttttattcataattttggtcgtatgtatagttgtcaattattatattgtatttaacgaacaaaatatgaccatatgaaaaacgcgcgaatcgttatcctttattataagctgagttttttgattctgtttttgcttttgaagtctgctttactattggcaacagaggatgtcatctacaacctcaaatttaagcaactttctgcaccatattccttgccgacaaatgaagtacaaaaagtgtatcaagataaagatggatttatctggttcgctactcgtaatggactttgccagtataatggctatgagaccactctttacaaatccaatctttactctccggatttattgactaccaatagcatcacttgtttggttgatgataataataatcatctttggattggtacatcggaaggactgaacgtgatggataaaagaaccggagaaataaaaaagtataaggcaccatatctttctaacaatgtagtgtctgctctgtgtgtgactcgcgataatactgtttgggtggggacggataacggtttatgtcgttatgttgcagagaaagatacttttgtagtttgtggagatgactttggagatagtagactgcggtatgttaccataaaatcattattagaagattcagatggcgatctctggattggaacttgggcacaaggcttatttcgttattctccatccacagataaagtggaaatatatccgaaaatcaatgaccaatattcttctcatgtaatttatgaagatagtaataaagatatttgggtagggagttggggatatggtctttttaaattgcagaatcctaaagatatgcaacgtgtgtcttatcagcgttttctgcatgagaacggtgatgattccagtttgtctgataatatagtatatgatatagcagaagatatcaatactcataccctgtgggttggtacacgtagtgggttgagtatcttaaaacttgatgaaccggacgcatttattaattataaatcgggaaaaacagattatcgtattccttctgacgaggttaactcgattatgcgtgatgctcagaggaatatgtggataggggctattgggggaggagttctgatggctgatacacgtcaatctacatttgctttatatacacttaactttggagatgaagatattccggtaacttccgttcgtaccttatttgctgattcagatcaaaacctatggattggagtaggaacttatggactggcctgtagagagtatgaaacaggaaagctaaagatgtattcgcacataccggaattttcggggttaaaagatttgccatcccttttcgcagttacccagcgtaagaagagtggtgaaatctggtttggtatgtataatggaggaatctacgtatatcggaaaggtgaaaaggtaaaacacttgactacaaagaatagcggtttccttacttctgattgtgtgtcggctttatatgaagattatgaagggaattgctgggttggcacgcgaggaggaataggggtcagattggctgacggtacagactatcgctttgaaacgatgaactttaatgatagtttgtcggcaggctggatatatgtaagagatatcataaaggatatggatagcagtgtctggctggcaacttctaatttgggtgtgattcatataacgggggatgtccgtcaaccttccacattgaaatatgagaattatagttttcataatcgtaagctaatcacaaatgcagttctctgtatacatcttgatcgttttggtcgattgtgggcagggactgagggaggaggattatacctttataatcgtaacaaaggagaatttgaggaaaaaacgcgtgcatatagtattccgggagacgttatcgttagcatagaagaagataaaagtggtaatttatggctgggaacgatttccggactagtgaaactttatgtagctgctgttggaaatgatttctcgacccgtatctatacttctgctgatgggttgcaggataattttatagtcaattcatcgtgtagtcgaaatggagaattgttttttggaggacataagggttacaacagtttttttcctgataaaatggaaataccctctcaggaaaccaatttcctgataacagatattaaaatattcaatcattctttcagtaacttgccggttgaactgcagcagaagatttcgccggtaatgcctacctataccagtaagattgaacttcctcataaatacaataattttagtattgaatttgccgcccttacctataagaatcccgaactaaacagatatgcttaccggctacagaactttgacagggattggcagtatacggatgcagaccgccgctttgcttattataacaatctgccgagcgggacatatacttttcagttgaaagcaaccaatgagaacggagaatggagtggctatgtacgtgaattgacagtggtagtccttcctccgttctgggctacctggtgggcatatctgctctatgtgataatagtatcagttataggagtttcgatttaccgtacagcaaagaatcgtatattgcttcggaatgccttgcgtctgcgtgaaatagaaaaagcaaaagcggaagaactgaatcatgcgaaattgcagttctttactaatatcacacatgaactattaactccgttgaccattatttcggctacagttgatgagctgaagacacaggcgcccagccataatgatttgtatactgtaatgaatagcaatatacagcgattaatacgtttactgcaacagattcttgaatttcgaaaagcggaaacaggtaatctgaagttacgggtttcgccgggagatattgctgcctttgtgaagaatgcggctgagagtttccagcctttagtaaagaaacgtaagatacacttttcatttctttgtgatcctgaatcaatgataggctactttgacatggataagttggataagattctgtataatttgttatctaatgcagctaaatacaataaagaggatggatttattcaagtctccttatcttatgatgagacagataaggattttatcctgttgaagattaaagataacgggaaaggcatttcaaaagagaaacagaaaaatctttttaaacgattttatgaaggtgactatcgtaagttcaatactattggcacaggaattggactttcgctgactaaagatttggtagagttacatggaggaaccatctcggtcgaaagcgaagtggatcatggtaccgaatttatggtacggattcctattgagcgttcttattatgatgaagagcaaattgatgatgaggctatctctttaatgcaaaatcctgtaaattacgaggatacacaggaggatgccgatgtagaaactcaggaagtgactataaaggctaacactatattattagtggaagataatggggaattactacacctgatgacaaagttattgagtcgtgaatacaatgtctttacggcccagaatgggaaagaaggcattgcagtattagaaaaagaggatgttgatttgattgtgtctgacgtaatgatgcctgagatggatggtattgagttctgcaagtatgtgaaagggcatctggagatgagtcatataccgatgattctgctgactgccaaaaataaggaagaggacagagcagaagcttatgaaattggtgcagatgcgttcattagcaagccctttaatctgacagttcttcatgcacgtattcgtaatctgctgaaatataaggaacgaatggcgcgtgactttaaaaatcaaatagtttttgaggtgaaagacctgaattacacaagtttggatgaagactttattcaacgtgctatccattgtgtaaataatcacttggaagaccctaattttgaccaggcgcaatttgcagatgaaatgcgtacaagtaaatctacgttatataagaaattgaaatctttggcaggtttgaatacttcttcttttattcgaaatgtccgtttgaaagcagcttgtaggataatggaggaaaaaggcactaatgttcgtgtttctgaacttgcttatgcagttggtttcaatgatcctaaatactttagttcttgtttcaaaaaagaatttgatatgttaccgtctgaatatattgagcggtttattcaaaatgtataggcatagataggggtaacctatttaccaataattattttgatatgcatatttgtaaaatagtgcattgtagggtgtaacaaaccatattctgaggatagcagagttatagttaagtttagtatggcaataagctatactcttcgaatatttaatcagttttctttgtagtattaatattttttgccccattagctaattcgttccactatagttatcttttcgttctactatagtggtgcgtaaagggaactatagtgcatcttgcgtaccactatagtggcacgaactaatatgactaacaaaaaacttaattgttcgtagctaaggacttaagaatgtgagcgataacctgcaaggagtgaactgatttcattaacggtttaccatataacaaattattgttttattgatgttatgttatatgtggtttttattttacagatcagattatccttattccttggtcgaattatagtttaaaaaggaggaatatctataattcgacctcagataactcatattggacctcatctggagtgacttaacttacatttgcacttgttaattggtcgttgaaatcataaatcaattaatgaacggttaattttttatttactaatatcttaaatatttttgctatgagaaattgcattttctattctttagtgctagcacttctctttttaataggaagctgtaaagatagcgatgacaacaaaaccactggggcgacttatgatccgaatcagcccgttacagtggagagctttatgccggtagagggcaagctacgggaaaaggttatcgttaaaggttctaactttggtacagacaaatcaaaggtgaaagtttattttgtggacgaggcagcagaacgcttatctacagtaataggtatcgataataataccctttattgtcttgcacccagacaattgccgggtggaaaccgtatcaaggtaattgttgatgggaaggaagtgactacagatggcacatttaagtatgaacaggcccagaatgtttctaccatctctggttcggcttcaaaagatgggaatgatgatggtgaccttgcatctgcaaagttcaagtacatgtggggaattgcagccgtaggaaataatacggtacttgcttatcaaagagatgatcctcgtgtccgtttgatttcggtggatgataacaaggtgactaccgttcatccgggttttaaaggtggaaagcctgctgttaccaaagacaaacaaagagtgtatagtattggttgggaagggactcatacagtatatgtctatatgaaagcaagtggttgggcacctacacgtatcggacagcttggttctacttttagtggtaaaattggtgctgttgcattggatgagacagaagaatggctctattttgttgattctaacaagaatttcggtcgcttcaatgtgaagacacaagaggtaacattaataaagcaactggaactctcaggatctcttggcacaaatcctggcccttatcttatttattattttgtagatagcaatttctacatgtctgaccagaatctgtcttcagtttacaagattactcctgatggagaatgtgaatggttctgtgggtcggctacccaaaagacagtgcaagatggtcttcgggaagaagctttgtttgcccaacccaacggaatgacagtggacgaagatggaaacttttatattgttgatggatttaaggggtactgcttgcgcaagttggatattcttgatggctatgtatctactgtagctggtcaggtagatgtagcaagtcagatagatggcacaccgctggaagctacctttaactatccttatgatatttgttacgatggtgaaggtggctattggatagctgaagcctggggaaaagctattaggaagtatgcagtagaataatcactaagaaaaacataaatatgaaacgaagtattttagtactattttgggtattcatgtcagcaactatgttcgcccaaggcggaatagatgttgcgggtatcgtcttggacgagcaaggacaggaactcatcggagtgtctgttcagataaaaggaaaacagggtgtaggagttgttaccgattttgacggacggtttaagataacaggtgttcctgccggaagtacactcgtattttcttatataggttatgaaactcgggaaattaaatatactgctacgaaactgaaagagaagattgctttgaaggaggcggtcaatgagtttgatgaggttgtggtagtggggcgtgatactcagagaaaggtttctgtagtaggcgctatcaccaatgtagacccggcagggattcaagctcctgcggtatcggtgagtaacatgttgggtggacgcgtgccgggcattattgccgtgacccgaagtggcgaacctggtaacaacttctcggagttctggattcgtggtatgagtacgtttggcgccagttctagtgcattggtgttgatagacggaatcgaaggaaatatcaacgatcttgatcctgctgatatcgaaagttttagtattctgaaagatgcatcggcaacagccgtttatggaactcgcggtgccaatggtgtagttgtagttactacgaagcgaggaaaagccggaaagttgcatgtcaatttcaaaactaatgctacttattcttattcaccccgtatgccggaatatgctgatgcttatcaatatgcaacattggcgaatgaagcgcgctccgttcgtggagacgacccggtatattctgctactgaactagaattattcaaaacaggtcttgacccggatttatatccgaatgtgaattggcgtgatgtgattttgaaagatcatgtaattaacaatcaacaccatttaagtatttccggtggtggacaaagtgctcgctactatatgagtttgggtatccttaactctgaagctctatttaaacaggataagtctgcaagcaaacatgacgttaatgtaaactatcataaatataatttccgtacaaatattgatgctgaccttacaaaaacaactttgttgagtttgaatttggaagcagtaatcaagacacaaaacgcaccaggaacaggctcaagcaataaatacctgtgggaatcgcaagcgaacttacctcctactgtggttcctgtgaggtactctaatggtcagttgcctgcttatggcactaatctggaggataaatcaccatatgtacgcctgaattacatgggatatactaccaatgagacgtattctaccaaaataaatgtaggcttgtcgcaggatttgggtatgatcacagagggattgtcagtacgtggcttgttctcattctctatgaatggtgcacacatagtcgacagacatatgaaccccgaacaatattatgccgatcccaaagatggacgttatttggatggtagcttgaaaactgtgcgtactgtaaataaggaggatatgacagcaacacagggatcagcatccaatcgggaattatatttcgaagctgccgccaactataaacgtttgtttaatcaagatcaccgtgtgacggggttggcgcatttttaccgccaggaactgaccaatgtggattggggaaacggtgtgttagtcagcattcccaaacgttatcaggcactttccttccgcgctacctattcttataaagatacctatcttgtagaaggtaatcttggctataccggttcggaaaatttcaataaagaacgtcgctacggttggttcccctctatttccggggggtgggtgcctacgcaatatgattggtatagaaatctgctcccattcaataacttcctgaagttccgtgcttcttggggacgggtaggaaatgatcgtctgaaagatgagaatggtaatgatattcgattcccttatttaactactttaggtaacgtttccagtacatggggaaccggacttgccgaaaatcgtaccggatcaatgaatttaaaatgggaagtcagtacaaaaacgaactttggtatcgatgcccgtttctttgatgataaggtagacatgacagtggatttctttcatacgaagacaaccgatattttccagaggcgtgccaatataccggacgagggtggtttaagcaatgtacttccttatgctaatatcggaagcatgaagtcgtggggtatggatggtacactagcttatactcatacatttaataaggatatggctcttactgtacgtggtaactttactcacgctgaaaacgaagtgatctactgggaacagagtggggtgaattatccatatcagtctaattccggagtcccttacaaagtacagcgcggattaattgctttgggattatttaaagatgaggatgacattaaaagtagtcccaaacagacctttatggataattatcgtccgggcgatatcaagtataaggatgtgaacggtgacggtaagattgataaagatgacgtcgtacctctcaactactctgctgtaccgtttatacaatacggttttgcacttgattggaactacaaggcattccgtgttagtattttgtttgaaggagtctctaaagtacaatattttcaaggtggtcggggattctatcctttcttaaatgaatcaagaggtaacttactcgaaatggttgctgatccaagaaatcgttggattccaagagaatatgctgaggttaatggcattgatcctgcattggcagagaatccgaatgctaagtttccgcgactaacgtatggagaaaataaaaataataatcaggagtctaccttctggttagctgacggtaaatatctgcgcctcaaaaatgtagatgtctcttaccgttttacgaataattggttgaagagtcgtgtcggtgtggaatctgctactctcagtctgataggcgagaatctacatgtgtgggataaagtgaagctttttgatccatcgcaagcctctggtaatggagcggaatatcctttgcaaaggatgtacaccttacagttgaacttaactttctaaaggacgattattatgaaaaagaaaacaaatattataaagactttatttctgtcgatggtttgtagtataaccatcgggctgcaatcttgcggtgattatctggatgtcgaagaatatattgaccagatgacttttcttgactccgtattctctcgcaaagaactcctggatcagtatattaacggtgcagcgcaatatatacccaatgaaggcaaactttggtcaaattcttctacaccgttccaaattgcttctgatgagaatttcatgtcctggaatgatagccagcactacggcatgaagtttttgctggacgagattactccttatgacggatattacaataactatcccaaatattatcagggtattcgtatggcactcactgccttgtcgagaatcaatgaagtacccgatgtgacagacgttgaacgtcgtgagttgatgggacgatgctactttttggtaggatattattattatctgctgatgttgcagtacggacctgtgcccattgttccggaaacgccctttaatgtggatgtgccggtagccgaaatgtcactggaacgaggaacatacgatgaatgcgtattggaaatccgtaaatggatgtctctggccattcagttcttgccactggaagtagaaagttcaacggttgtgacgcttcctacccaatgggccgcttacgctactttgtcaagaattacattgtatgcagccagtccgtggtataacggcaataagttttatgctgactggcagcggacaagtgacggcgcaaactttatatcgcaggaaaatgataattcgaaatggggagtgtctgccgcttattcaaaatacattattgattcaaataaatttgagttgtattggactcccaaagaaatagatagcaaggatctgcccactaatgaagaatttatcaaagagatagatccggattattatgagccttatccaaagggagcagccggtatcgaccattaccgttcgttgacttatacattcagtggtgaaattcctgtgatgattaatcctgaatttatctattcctgtcaaatgccgacaggtgatgccccattggtggctgctgcacctttcaaattaggtggatggggtggcttgaatctcgtacaggacttgattgatgcttaccaaatggtggacggacaagatatcaatgaatccagtcaggactatccttatccggatgccagcgttaattttgaaagaattggcggcgctaaccaaactttctctggctttacacttctggcgagcactgctagaatgtataacaatcgcgaacctcgtttttatgcaacgataggcttttgccattcattctggccaggcacttcttcttcggagaatcagtacaagaatattgaggttacttattattccgacggatatgcttccgctaatccggatcatcctgaagattataatcgtacaggctatacttgtgtcaaatatagacatttggaagatgagatgaaaaagggtacggtcaaagctaaatatttcccggttttccggtatgcggaaacattgctgaattatgtggaggctattaatgagttgaaagaaccttatacgctggagatgcctaacggcagtcaagtgacggtggaacataatacagctgatattgtgaagtatttcaatctgattcgtcatcgtgccggtctgcccggaattactgaggctgttgctgccgacaggaataaggtccgtgaactgattaagcatgaacgcagaatagagtttgcttgcgaaggacgtcgttatcacgacttgcgccgttggggagatgctatggaggcatacaatcgtcctatctccggttgcaacgtcaaagcaagaagcaatgaacgtcagaaattctacacaacaactattttgaacgataaattgacacggcgttcattctcgtacaaacactatttctatcctatacctaagagtgtgttggataaaaataaaaacctcgtgcaaaatccggaatggagataaacctatataatcaaaagaaatatgaaactaattagaactatttatacgttggggctacttgtaggattatttgcatcctgtagtaaagagagccctttggatggtgaacaatactacaaacaagtttatattgtaggtgcctatgaagtggtacagcaatttgatgtggcgtatggcgatggtccacaaaatgcgtatgttgccgttgctacgggaggtagccagaatatcgaccggaatgtggaagtcgtcttgactcacaatgacgctaccatcgaatggtacaataataagtatatgttggatgccccattaaaatatcagaagttgggtgatcaattttgcagttttccgtcaatgagcacgaccattaaagcgggcgatgtatatagtcggttgccatttactgtcgaaacttccggattggattgtgataaactttatgcgttgactttcaaaattgagtcagtatccgattacgtgaaacaacctaaggatacagttctcataatgaatctcaatttaacgaatgacttttcagggatttatcagatggtagccatcagatatacgttgactgacaatgatgaagaactgactccttcttccgttaatatgcagcgtacgttgaaggcagtgaataaaaatcaggctcgtttctttaatgttacgcagaattcagatctttcaccaactggaaacattacatctgaagattatttcaactcaattgataacaacggtgtgacgtttacacgtcaaccggacggtactttcacagtggctggctggaagaatcttccggtttctaacgggaccgttagttttgaggatggcacatttacattttgttacgattacgagtccggtggaaagaggtatcgcctgagaggtacaatgacgaagtaatcgataggtatttttatataggtagtaaatgcaggggatgagatgattgaacttgtctcctgcgtttgattatatgacttcagatgtgttctattcggtataaaatcgtgcaaagatgctcattattgagtcatttcaatgaatatgatctaaagttcgacctaattgcacgatttctagtcctttattttttattgaagtcttatttttgctgatgtaaatatgaatcattttatttattagggataaatagttcaataggtttggatataccaaagaaaaacaaattagtatgaagataaagaagattgtaaatttaatgatgggcttgtcattttcactatgcatatttgcccaggacgactggcaacttgtttggagtgatgaatttaatgcagatggtcctttgaactcttctgtatggaactttgagcaaggatatgcgcgtaatgaagaagctcaatggtaccaatccgacaatgcagtttgcaagaatgggctgttgataatagaagcccggaaagagcagaaccgtaaaaatcctctttatgtatccggaagtaatgattggcggaagaagagagaatttattgactatacctcttcttcagtaactactgccggaaagaaagagtttctgtatgggcgttttgagataaaggctcgtattcctgtggcaaaaggagcatggcctgctatctggacattgggaagtaatatggaatggccttcatgtggtgagatagatatcatggaatattatcagattaaaggaacaccacatatcttagccaatgctgcttggggaacagaccgtcaatggcatgcaaaatgggacagtcaggctactccttattcgcatttcactgacaaagatcccgattgggcatctaagttccatatctggcgcatggactgggatgaagaggctatcaaactatatttggacgatgaactgctaaatgaaattcctttgagcagcacaaggaatggaagtatcggtaaaggtaccaatccttttacaaaaccacaatacctgttactgaatctcgccattggcggaattaacggtggcccgattgatgaggccgccctgccgatgaagtatgaaatagattatgtaagagtctatcagaaagaaaagggaatcgcttccggaaaggtctggagagatacggatggcaatgtaatcaatgcgcacggtggcggaatacttttccatgaaggaaaatattattggtttggagaacaccgtcctgcatccggttttgtcacagagaagggaatcaactgctattcatcaacagacctgtataactggaaatctgaaggtattgccttagctgtctctgaggaagaagggcatgacattgagaaaggatgcatcatggaacgccccaaggtgatctataatgcgaaaaccgggaaatttgtcatgtggcttcatttagaactgaaaggacaaggttatggacctgcgcgtgcagccgttgcagtgagtgattctcctgccggtccctatcgtttcattcgctccggcagggtcaatccgggagcttaccccttgaacatgacccgaaaagaacggaaaatgaagtggaatccggaagagtataaggaatggtggacaccgaagtggtatgaagctattgcaaaaggtatgttcgtaaagcgtgatctgaaagacggacaaatgtcccgtgatatgactttatttgtggacgatgacggaaaggcttatcatatctattcctcagaagataacctgacattgcagattgcagaactggccgatgattatctcagtcatacaggaaaatatatccgtattttccctggtggacacaatgaggctcctgctatattcaagaaagagggaacttattggatgataacttccggctgcacgggatgggatcctaataaagcccgtttgctaaccgctgattctatgttgggcgaatggaagcaactgccgaacccttgtgttggtgaagatgcggataagacatttggaggacaaagtacttatatattgcctttgccggagaaagggcaatttttctttatggcggatatgtggcgtccgaagagcctggcggattcacgctacatctggctgcctgttcagtttgatgataaaggagtcccctttataaaatggatggataggtggaattttgattaatatcgtatatatagaagccggcggatatacttttcatatttattgctttcagcaataaatattctctatgagaaaggggaaaattccggaagattatacattttgcgaagaatggtctttttatatcccttttttgacggatatttgaactcttttctttatggtataggttatctttgtgagcgaatgatttcactgcgaggtgatatgtcggcagagaataatgagaaacatcaaaaataatgaaatatatatggtaagaatgttattactggtagtggtttgtatagggttactgccaatacaaatgcgagctcagaagaatagttatattattcccggggaagtgtggaaggatacggacggtaaccctatcaatgcgcatggcgggggacttctttaccacgacggtacttactactggtatggagaatataaaaagggcaaaacgattttgcctgattgggctacatgggagtgttatcgtacagatgtgacgggagtaggctgctattcttccaaagatttactgaactggaagtttgagggcattgtgcttccggcagtcaaagaggacccgaaccatgacctgcatccgtcgaaggttttggaacgtccgaaagtgatttataataaaaagacaggtaagttcgtgatgtgggcacatgtagagagtgccgattacagcaaagcgtgtgcgggtgtagctgtctctgattttccaaacggaccattcacttacttgggaagtttccgaccgaataatgcgatgagccgtgaccagacagtttttgtcgatgatgacggacgtgcctaccaattctattcttcagaaaataacgaaaccatgtatatcagtctcctgacagacgattacctgaaaccaagcggacgctttacacgcaatttcatcaaagaatcccgtgaagctccggcagtgtttaagcataagggcaaatattatatgttaagttccggctgcaccggctgggacccgaatgtagcggaaatcgcagtggcggattccatcatgggtacatggaaaacgataggtaatccttgtacgggtccggatgcagacaagactttctatgcgcagagtacatacgtacaaccggttatcggaaagaagaatgcatatattgccatgtttgaccgctggaaaaagaaagacctcgaagattcacgctatgtatggcttcctgtattgataaaagacggagctattaccatcccatggcatgaaaagtgggatttgaccgtctttgacaaacagaagaaatctgacaaatacaagaaatctgacaaacagaaaaaatagatcatgaaacggacactgctgcttacttttttattactatctgtttctgccttgtgcttttcgcaaaaactggtggaagttgccaaaggatatagttgtacatctgtcaatacaacgatattccgcaataattcattggtaacgcatggggatgagcaatatatcagctattatgatgccgatggctatcttgtgttgggcaaacggaaactaaattcgaagcaatggacattgcatcgtactcaatatcgtggaaatgtaaaagatgcccacaatatcatcagtataatggtggacggagaagggtatctgcacgtttcttttgaccaccatggacataagttgaattactgccgcagtatcgcccccggttctttggaactgggcgataaaatgccgatgaccggagtggacgaaggaaatgttacttatccggaattttaccctctgacagacggggatttgttgtttgtctaccgttccggttcttccggacgtggaaatctggtgatgaaccgttattcattgaaagaccataaatgggcccgtgtacaggatgtcctgattgatggtgaagacaaacgaaatgcttactggcagctatatgtagacgagaaaggtacgattcatctctcatgggtatggcgtgaaacctggcaggtggagaccaaccatgatctttgctacgcgcgttcttttgataacggagtgacttggtataagtcggatggtgaacaatataaacttccgattacagcttcgaatgcagagtatgcttgtcgtattccacaaaactcggaattgataaaccagacaagtatgagtgcagacgctggtggcaatccttatattgccacttattggaggagttcggacagtgaagtccctcaatatcgcattgtctggaatgacgggaagacatggcataatcgtcaggtgacagaccgcaagactccgtttacactgaagggaggaggcactaagatgattcctgttgcccgtccgcgtattgtggtagaggatggagaaatcttctatattttccgtgacgaagagcggggcagccgtgtctcaatggcgcatactgctgatgttgccaacggtaagtggatagtcaccgacctgacggatttttccgtagatgcctgggaaccgtcccatgacacggaattgtggaagaagcagcggaaactcaatctctttgtacagcacacttgtcaaggcgacggtgaacgcacggcggaaattgaacctcaaatgatatatgtactggaagcgaatacgaatacaaaaaaataaagatatgaagaaattgtatgcaactcttttttccgcactggtggtaggctgtgcggtgtgtgccggttgcacaaccaagaaagtttcatcttcggcagaagtggttgacattattcataaagtcaatggctactggcagacaaaccatccggaacacgggcgttctttctgggacaatgccgcttatcataccggaaacatggaggcttacttcctgaccaacaaaccggaatacctggaatactcaaaaggatgggcggaacataatgagtggaaaggcgctaaatcagataataaggccaactggaagtacagttatggcgaaagcaatgattatgtactgttcggcgattatcagatctgttttcagacgtatgccgatttatataatctggaaccggatacgcataagatagcccgtgcccgtgaggtgatggagtatcagatgagtacacccaacaatgattattggtggtgggcggatggtttatatatggtaatgcctgtgatgaccaaactatataatatcactaaaaatccactttatctggagaaactgcatgaatacctcgcttatgcagacagtatcatgtatgatgaagaagccggactttactatcgcgatggaaaatacgtataccccaagcacaaaagtgtgaatggtaaaaaggacttctgggcacgtggtgatggctgggtactggcagggctggcgaaagtcttgaaagaccttccggaaacagataagtatcgccaggaatatatagaccgtttccgtacattggcaaaatctgttgcggcttgtcagcaacctgaagggtattggacgcgtagtatgctcgatgcgcagcatgcaccgggacccgaaacaagtggtacggcattctttacgtacggtctgcaatgggggatcaataacggtttccttgactccgcccattatcaacctgtagttgagaaggcatggaaatatttgtcaacagttgctttacagcccgacggaaagatcggttatgtgcaacccatcggcgagaaagccataccggggcaagtcgtagatgctaattctacttcaaacttcggagtcggtgctttcctgctggcagcttgtgaaagggtacgttatctggaatcacttattcagcattaaactcatataaggttgtaatgcctgaaatattcttcctgtcagctcactgatattcattggtatatgtgcgccgggcaaacgctcggtgctatacatacatttaccattacacagatagtaatagccattatttactgacaattgtttatctgatacttccagttgcatttcgtcctcaggaaaagcagaggcgtacagttgcagcacttctttggcattgatgattcgcgccattcccaacggatattgcgtctgttctttctccggaggaagcaactgaatcatatgcctgcatcctgtaaattgcttgatatggtgcaacagactgtgctcggcatctttggtttctgcaaaaagctcgctgataattaattgcttatctcttctgtatacaatagccaatccattgatttgattttctgatctggcagtaaccaaaattccgtcactgaggataaggtccgccatgactacttgaaaatcctcaaaggagtgctggatgcagcaagtgcgtccggaaagtttgctgtttagatattcgcaaacttctttctgacatccgacttcagaggtgactgttatttctttagacggaataaattccggtacagtaatctctttaaccgaatattggaatacggaagcatatcccatccgggtgtaatagtcgaataaccaaggttcggcgggaatcaatgtactgaaatacgttccgttacgaagcatccttgcaaaggcttgggagagtaattcgcgcatcactccgtttccacgaaaatccggatgagtgcaggctcctgaaatgtaagaggtctgtacggtatctccgcagaaagtcattggataaggaatcatctgaagagcggaaacaatctcatccccactttcgatagcaacgtttatttcgtttttatagcgcagcctgaagtacatttcaacgaactcttcattgtcgtcgaaacataactgccataatgccttaaccttttcttttgtcgtcataccttatatattattaccatctgaccatatccataggatggtctttcagacaagccatatacttttcaaggatagttaccggttgataagacagctttgctttgcgtaagccttcaatacctaaatcttcttcccggttgatatagatatactgttcgggaatgcggttggcaaactcgtaattaatcatggcgtaagcaccgtcaatgctggtatctgccttttctacatgtaccccgaatgtttcatggttgataggcatcccgaaagtaaatgccacaattttcccgttgacgtggagaatgcctccggtcagaccgagtgcttcgaaattatgtaaggcataaatgagggcacgacgttcatttcccgttccttcctgctggtcgcagttgttcattttgcaccattcggcctccagatccagacattcttgaatacggtcgggcgtaatcggtgtatattcgtaatcgggatacgtattacggaaccggttgatatgatttctctttgcctgaaatttctttccttttaaggtagccagatcactccttaaatatatatagtcggcataggcacggtcttccgtgaaaatgaaccgttcgggtaaaatcgcttcgaggtcggcacgcatattgctgcagactcccaacatgcagaaattatgcttctccttatccgcatcttcgattaatttccgtaatacagctttcagatcgccgtttcctataggcatcatatatgccagttgttcgccggcccaaaatttgaataccagaaaatcgtcgatgactgcaaattgagtatcgtacaagaacctccagctacagaggttggaaaatgaaagatcgcagtttcggcggtcacttttcatggtgaatgcagttattgtgtctctatcagctagtgtaatgtctttaaatggaatcataaaatgctttttgcgtttaactctttatataacggaaaatgaaagaattttgtttttacaaaacacctaataatcgcaggatagtcggtgtcagtaatgcggtgaatattccattcagtgtcaatcccaggctggcatacgccccgtatttgctgctgatgtccatggcggtggaagtgccgacagcgtgggcggctgttcccatcgaaagcccttgggctatcggactgcctacgtgcatgattttcattgtcttaaatccgcagatggctcccagtaaacctaccgctactacaacggctgccgtcagtgacgggatacctccgatagccttggtcacttccatggcaatcggagtcgttacggatttaggtgccaatgaaagaatgacttcttgtgaagctcccataaacttggcgattaataccacagagatcactccgacgatgcaccctgccagttgagacaagaggataggcagcaattgtttcttaatcatttccagctgaagatataaagggacccccaaagctaccacagccgggcgtaaccagaattcgatgagatgccctccctgattgtaagtctcgtaagagatattggccattttaaggaagataatcagaacggcaatggtgagtaagatcgggttcagcaataccagccccgttttcttctgaagcaatttggcaaagaagaaaacgccgaaagtgacagccagcagaaagaaattattttctaaaaagctcatttgtctttattcattaagttagttttgttttttaaatgtagcttgtcggacaagtgaaagtctgataagcgtaggctacgcgccagtttgatctgacgtgccagtctgaatttacggacaatctggtgtacccatcccgttacgaccagcacgagagccgtgctaacgattgtcgcgataacgataggccagaactctgccgcaataacgtcgaagtacaacatcaatgctactccgggaggtacgaaaaagaagcccagattagctaccagaaagtcggacaatccctgcacccactgcagtttgatccagcctaatttcaaaaaaagggtgagcagcagcataccgataatgctggaggggagcttgatccctgttaaataaacgattaattcacccaaagccaaacagccaaataaaatggcacactgacgtatcatacactaattacctattgatttgtttgaaaacactgcaaaggtagaaaaaatagaagtacagtgttaaatattataatattttagacttggagaataaaattagccggaattgtaatgtggatattgcaaaattgagtacttttgcagcgcaaattacaaatcgtaacaaggtttataatattattcaaatatatctatgcttaatttaatcaaccaaatcgtggctcgtgcgaaagcagaccgccaacgtattgttcttccggaaggaactgaagaacgcacattaaaagctgccaatcagattttgacagatgaagttgctgaccttattttactgggtaaacccgctgaaattaacgaactcgcagtgaaatggggactgggtaacatcagcaaagctactattatcgatcctgaaacttctccgaaacacgaagagtatgcacaattgctgtgcgagcttcgcaagaagaaaggcatgactatcgaagaagcccgtcaattgacgaatgatcctttgttttatggttgtttaatgattaagagcggtgatgctgacggtcagttggcaggtgcccgcaacacaacaggcaatgtactgcgtccggctttacagattatcaagactgctccgggcatcacttgtgtatccggtgctatgttactcttgactcatgctcccgagtatggtaagaacggtattctggtgatgggtgacgttgccgtaactccggttccggaccctaaccaactggcacagattgctgtttgtacggcacagactgccaaagccgttgccggcatcgaaaatccgaaagtggctatgctgagtttctctaccaaaggttccgctaaacatgaagtagtggataaggtggtggaagctaccaagatcgctaaggaaatggctcctacacttgatctggacggagaaatgcaggctgatgctgctcttgttcctgaagtaggtgcaagcaaagctccgggttcacccgtagcgggagaggctaacgtgctgatcgttccgagtctggaagtaggaaatatttcttataaactggtacaacgtctgggacatgccgacgctatcggcccgatccttcagggtatcgcccgtccggtgaatgacttgtctcgtggttgctccatcgaagacgtatatcgcatgattgctattacggctaatcaggctattgcagcaaaaaacaataaataagtatcaagtattaagtattaaagacaatatgaaaattctagtattgaactgtggcagttcatccatcaaatataaattgttcgacatgaccaccaaagaagtgattgcacaaggtggtatcgaaaaaatcggtctgaaaggctctttccttaaattgactttgccgaatggcgaaaagaaagtgctcgaaaaagacatcccggaacatacgatcggtgtggaatttattctgaatacattgattagtccggaatacggagctatcaaatcactggacgaaatcaatgcggtaggtcaccgtatggtacacggaggtgagcgtttcagcgaatctgtattgctgaacaaagaagtactcgaagcttttgctgcctgcaacgacctggctccgcttcacaatcctgccaacttgaaaggtgtgaatgcagtttctgctattcttcccaacattccgcaggtaggcgtatttgatacagctttccatcagacgatgccggattatgcttatatgtatgctattccctacgaaatgtatgagaaatatggcgtacgtcgttatggcttccacggaacttctcaccgttatgtttcaaaacgtgtatgtgagttccttggcgttaatccggtaggacaaaaaatcatcacttgccatattggtaacggtggttctatcgctgctatcaaggatggcaaatgtatagatactaccatgggactgactccgttggaaggtttgatgatgggtacccgtagcggtgacattgatgccggtgcagtaacatttatcatggaaaaagaaggcttgaatacgacaggcatttctaacctgctgaacaagaagagcggcgtactgggtatttccggcgtatcaagcgatatgcgcgaactgctggccgcttgtgctaacggaaacgaaagagccatccttgctgaaaagatgtactactaccgtattaagaaatatatcggtgcttatgctgcggcattgggcggtgtagatatcatcctgtttacaggtggtgtaggcgaaaatcagtttgaatgccgtgaatctgtttgtaaagacatggaattcatgggtattaaactggacaataatgtgaatgcaaaagttcgtggtgaggaagctattatttctactgcagattctaaagtgaaagtagtagtgattccgacagatgaagagttgttgattgcatcggatacaatggatattctgaaaaagtaagaagaactgagataataaaaaaaggcggcttatcatgaagtcgcctttttttgttaactcttttataagtctcgttttttttaccttactttgtgcttcaaatcaatattcgttttattggatttacgcaaaatcgttattttataaattcattgatatgcgctattctgtcataattcccgtttacaatcgtcccgatgaggtggatgaattgctgcaaagtctcactgtacagtgttttaaagattttgaagtagttattgttgaagatggttcatccatcccttgtaaggaagtggcagatcggtatacagatcggttggacatcaagtatttttctaaacctaattccggaccggggcaaagtcgtaattatggagcggagcgaagcgaaggagaatattttatcatactggactctgatgtcattttgcccgaaggatattttgacgcgatagagaaagaacttcaggcttctcccgctgatgcgttcggcggtcccgaccgtgcacacgattcttttacggatattcagaaagccatcaattactcgatgacttccttctttacaacaggcggtatccgtggcggaaaaaagaagatggacaagttttatcctcgtagcttcaatatggggattcgtcgcgaagtgtatgaagctttggggggattctctaaaatgcgcttcggggaagatatcgacttcagtatccgtatttttaaaggtggctatacttgtcgtcttttccctgacgcatgggtatatcacaaacgtcggacagacttgaagaagttctttaagcaagtccataactccggcattgcccgcattaacctttataagaaatatcccgattcgttgaaattggtgcattggctaccggcagtgttcacgctgggagtctctttgcttttattactgactcttttggggttggggctcgttctgttagctttttatctgctatattccaaaacggttcccggatgtgcgacaggtgagatggcacttctgtttttaggatttgccgccatgttggcagcacctcttcccttactgctttattccttggtggtttgcgtggattcgacaatcagaaatcgcagtttatggattggaatgctgtcgattactgcttcctttatacaactaattggttatggaacgggattctggcgtgcatggtggcagcgctgtataagaggaaaggacgaattcgaggcttttcaaaagaatttttataagtaagtgacttgatcatggaaagcaaacacaaactatccatcaaccagtgggcgctggaagaccgtcctcgggagaagatgatggagaaaggagcagccgcattgagtgatgccgaactactcgccatattaataggctccggaaatacggaagaaagtgctgtcgaactgatgaggcgtttgcttctctcttgtgataacaatctgaactccttggcaaagtgggaagtctgcgactattcccgttttaaaggaatgggaccggcaaagagcatcactgtaatggctgctctggaactcggtaagcggcggaaactgcaaaatatccaagaacgcccccgcatctcttgttcaagagatatctacgacatcttccagcctgttatgtgcgaccttgaacaggaagagttctgggtattattattgaatcaggcgacgagactgatcgacaaggtacgtatcagtaccggcggaatagacggaacgtatacggatgtacgtaccattcttcgggaagcactgctgcaaagagccacgcaaatagccgtagtgcataaccatccttcgggaaatatccaacccagccaaccggaccggacgctgacggaacacatccgccgggcagccgacacaatgaacattcgcctgatagaccacgttattgtttgtgaggataagttttacagttttgccgacgaagggctgctctgaataaatttattcttatctttgcaatacatattaataaggaaagccctatggaaaaatttaaaatagaagaaaagatcgtagccatgctaaagacggtgtacgatcctgagattccggtgaatgtatacgatcttggactgatttataagatagacgtctccgacaatggggaagcagtgcttgatatgactctgactgctcccaactgtccggcagccgatttcatcatggaagatatccgccagaaagtggaatcggtggaaggggtgacaaccgccactatcaaccttgtgttcgaaccggaatgggataaagatatgatgagtgaggaagcaaaactggaactcggattcctgtaaattcatagctcaaaacataaaattgataactctaaactcaaaactcatgaagaacgtttatttcctttccgatgcgcatcttggttcccgtgccatagaacatggacgtacacaggaacggcgcttggtgaacttcctcgacagtatcaagcataaagcttctgccgtttacctgttgggagatatgttcgatttctggtatgaattccggttagtggttcccaaaggatacacccgctttttgggaaagctctccgaactcacggatatgggagtggaggtacatttttttaccggcaaccatgatatctggtgtggggattatctttctaaagaatgcggagtgattattcatcgtgaagcattgactaccgaaatatacggaaaagagttttatctggctcacggtgacggattgggtgacccggacaagaagttcaagttgttgcgctggatgtttcacagtacaacacttcagacactgttttctgccatccatccccgttggagtgtggaactgggcttgacgtgggcaaaacatagccgcgaaaagcgggtggacggcaaagaaccggattacatgggggagaataaggaacatctggtgctttatacaaaagaatatctgaagagtcatcctaatatcaactttttcatctatggacatcgtcacattgaactggatttaatgttgagcgctacttcccgtgtgctgattcttggagactggatcaacttcttttcgtacgctgtattcgatggggagaatcttttcttggaagagtatatagaaggagaaacacaagtttgattcttatccattaaaaagcggaaattccgattgatataaggtttctttaagatgaatagaaaccgtaaaaagtcaagaccacgtcttcaggttcattctattttttagatgatgaatgtatgaagacgtggtcttgatgtatttagttgctcaacttgaatactacagaggcatatcctcccagtttcagggtgtaactgtcgctgtctgtattttgttgcgcctcgccattcacaaacaatactttttcaatcttgtctgtcagcggaagttgcatggccgttccgccgaaattatggatgacaagcagtttctcgttgcttttggtcatataccaggcggcaatcggcttatagtctttctcctgcgattcgttgtagacggaatgtttggtcatacttccttctgccagtgccggataggtgttacgcaatcgggtgagggagaggtatatgttcagaagtgaatgggtatcggcttgttggtcggctaccgttttcacattttttgagacggtggcatccgtcttgtctgtgtagttggtagtgtagctatctccccatagcatcgggctgcgcacatattcgtctccgttatcctttgttccgtaaagtcccagttcttcaccgtaatagatgtagggatgtccggcagaggtgagtaagacggcggccgccagtttgcatttgtcggtggatttgcccaacttggatgatgtacggtcttcgtcgtggttgctcagtttcgttgcttcgatgtagtcgcttcgatagtcggcgtatttctgttggtaagaaaggatgtctttggcaaaataacatccggtattgttgttgattccccattccagtcggtaccagaaggaaaattcaaaaagggcgggcagacctttataataaggagctactttatcgtattccgacaacacttcgcctaccatatagaagtcgtccgtatgtcctttttgtttgtaataggcgttcatatcctcatagaacattttcaggaagcgaggattttcttcgctggtctcactgtggtagatgtgcttcacggcgtcgaggcggaggccgtccacaccacgggcgatccatcctttggcggcgtctgctattgcctgatatgccggtgattctcctgcctggtctacagggccgtagttaaggtcggcaaaccaatcggtgcagaaatgagaatggaaataggtgatctgctggctgtcgaacatgatgttggcagggctgccggcgttggtcagtttgaagtccttgttcagcgcgagtttctcggacgaagatgaggcgccgtattttgttcctgatggccaggaagagtcattgctggtacggatcagaagcccccaagtggactcaaagtcgatggtgagttcatagatgttgtttcctttgtcataaaactttttgcagataccgtctccgtagtataagtatttggcgttgtcggtgcctgtgtccggattatcctcgtctgctttggttcctgtggaaacgacaaggatgggagaagatgcgttgctccagtccaatgtaaatttcagcagtcctttcacggcagcggtctcgtcagaaacctgaaaccattctgcggcattgtatccggctgccccttcttgtgtgatcatggcgattttgcctgctgcgatatctgtcttcgggtcttcagagaaagaataataattgcgatacgggctttcggatgatgaactggcttcggtgaaccacgggtgggcggtgccggtgtggttcattacgtagtccagataaatcttgatgccccggttgtgggcttctgtaaccagacggtcgaagtcgctttctgtgccgagctgcggattgactttggtgtagtctgtgacgtcatatccgtgataagacatacaggggtggatgggagagagccagagggctttcacgcctagttggttgagatagtccagcttttgggtgacgccattcaggtctccatatccgtctccgtcgctgtcggcgaaggaatagaccagtaactggtaggagatatctgcccgtttggtctcgtcccatgtgtcgggagaggcggtaagtgcggtccattgcccttcgatgggcggttcgggttccggagcaggctcggtgatatttttgtcatcgctgcaagcggtcatgaatgccatgagcattgacaaccacaaaagagataataagtggagatgtttattcataatgatgatgtattaaagacaataaatgtagtctcttaaaaaacagtggccgccccgattttattgtattcgcgacggccattccctgtttccctgatttcttgtagtattattcgatacggcctgttccgttgccgaagttcagataaaccttttgtccggttttaccttgtaccgcagcttggtcaccgccgttgccccgataagctatttgtccgtcgaagatgataaactctgttttccaccagtcgccggcagagacagctttcggatttacgcagattcgtactgcgccatctttctggaatgccggagaaacaaattcaccatcagccgttccgggcacggtaaataaatcctgttctaccagttgcgcgtcccaaccattgtatgaggtatcgcccatcagatatacattcggcttttcaaattctatcactttatcatcaccgatagcggagacgtatactaagtaccagccggctataccgacttttatgttgccgctctcgtccgacaatccggcaaggtctttggattcctgtgagatagcatctacaaagccgaagtcattgccccagttggcttgcggtgcaaacttcacctgatcgttagctgcgaaatagaagattccccagaaagttcctttcgttccgttgaccggaacaagtgctttccaagcattcggatcaccggcaggagttccccagttgtatgcgctgccggtcatgtaaagttcggtgggcgcactgttgtctttcactgtaaaacggtagttgaaagcatcgaacgagattttaattttaccgtccagtgctgtattaatggctcccgcattcgtccagctaacaaaattatcaccggagtcatcaccatctacactacttcccaaggctttggtccagtctatgtcgtttccgttaatagctgaagccgggaaaatcttgaagttcgaagtactttctatttctgcttccaatatatacaggttttcattgagagcgtccttcttcatctgttgggcactgttgccgtcccagcctgtgaaatcaccgactatataatagccgtcgggatcaaggggcggagttgtggcaggctgcaaggtgatgcttacttcatttcccaccagttgaataccttcaccggaaggagttacggcagaagcattgatagagattttcaattcacgtaccacgcttgcacggcttttgtaggcttcctgcgtcacactgtccagttgtgccaaagctactttaaagacatgatcttccgtcatggaaaatggaatggtgtgattcttattcagtgtcaaagagttgacagcgatcttactgccttcttcggctgtggtcgagcttaactttgcaatttctacggaatcggctgtagccgcgtccatgacgatgctggcgtccttgcctgctgtgaaagttgcagtcaactgtcccgccgactcttcttggggattggactggggatcagcccagtccttgaaatcttcgttacaggcagaaaatccgattgctgccagaaacatccctgtgtatattaaatgttttttcatgatgaatcgttctttttaaagttaattacttcttttctcctgtacctgccgtgaagttcagatggatcacattgccggctgaaccctgtacggaataaccgtctcccttttctgtccaactgtcaataaggttgaaatcacgatagaagatttcaccgtcatggagtgtaaactcagttctccaccagtcgaggtctgtcttgaagcacatacggacttctccgcttgcagtcatggcaggagatacgaagttaccgtctttggtggcgggaaccgcaaacttccattcgtcggtgaatgcccacgaaccgccggtggtgttaccgaacaaatatacttcagccggatagaaggtaatggtaaactgatagtcatcccctttgacagccgctttgacgtagaagagataccatccggcgttttctacgacgaagttgtcactgccgctgactcctgctccggctttgtcggtaaccgtcacgcggttgtcgttaatgccgatatactcgttttcctttgttccgaacttgaactcggagttggcatcgaagtaaatcattgaatagaactgaccgtccataccgtagacacctgccatcggtttccatactttccagtcggcatccagcatagagcctacaacgaacattgtcttgggaggtgtcaatgagctggtgctcttggaaatcagaacgttgggtaactcaatcacattggaaaaacatactccttttccactgcttgtgatgttggccttcaggcggatatatacagctaccggttcggtagggagttctgcctgctctccgttcacggccgtccacaagtcgagaagcgcattgttgagttcggaagcatccacattgatctttgctgtcggggaggtgctttccaacactgtatagttggctttgctctcatctgtcgcttctatgaaatcctgttcaaatgaagcttgtaccgtgtaggtggtagctgccggaaaaccgtagtccggttgcgaacaagtgagttctacagtctgggcattcttcaggtcatatacattgttggctgcatacgcaggcgtattgagcgtgaatgtatcgggttcgttcaggaccggattgctgtcattgtctgtttcgcaggctgtaaatagaggcagtgcgaaggtgacagcgagtaatatgttggatatttttttcataatggcattcttttatataaggatgaactcttggttatttatagccttcattttgtgacatattcctgttattgtttatatccgatacagggataggatatttgttgtagtatgaagcgacagatgttccgttcattgctccacctttccagtcccaaagatatttattggttgtgaacataccgaaacgaaccaagtctgaacgacggcgaccttccagatagaattcacgtgcccattcgtcgataagttcctgttcggttacggtctgtacctttcttgtacagttggcgcgtttgcgaagttcattgatgtctcctgtggcgtctcctccctggcggaaaatggcttccgcacgtgtcaggtatgcttctgccagacggaacaaaggaatgtctgtgtcaggataagtagcatggctgacaggttttccgtcagagcggtaattctgccattttacaatcgacaagccatcggtgaatccgctgatcgcatctgtctgaatcttgcgtctgccgcctcctacaccagagtatagcaaggcacggtcgtcaccggcagctttgatcatgtcttctgttctgataccgtattttgcatcaaaatcatcgatctgttcatccgtatctaagcctttggtcggaatttcaacatcggcgggcagcatcggcacatcttcgagattggagaagaacttttgtaccattgctgcacgggcaaagatacaggaccaaccgttcgttgttcccatacggggcataccggctacacgagtaccacaaaccagataagttgaaccgccatagttacgtgttttcactccatcctgacggataggcagaatgatttcctgcatggcattttcattctcgtcgttatcggccataaacagttcgctgtaatttgtacatagcttatatgctgagccaatcactttactggcatattcttccgcttttgcataatcggtttgtccggtgtatacgcctgcgttcaggtacaaacgtgcgcggagcaaccagttggcggctttgtctgcacgtccgaagggagcctggcgaggttcatacatatcaccttcaatttcgttcagttcattctgaatgtaggtatagagttccgtacctttcttctcgacaggcaagtcattgttaaagtgttccttgaacggagctttaccgaacaagtcgaggaagtaccaataatggagggcacgcaggaaacgtatttccgcacgttggcgcagtgtttctgcatctgtcatgccttcggtctggtcgaggaagaagttgtattgtgtgatgtcatatcccaaacggacgtaaacccactctgtgcgctggctggaaggactccagctaatacttgtaagctgggggatgtcctgattctcctgccaagcccaaagacattcgtcggtaggcagttcgttgcagttgaaagtggtacgatagaaaccggattcgccttcgtcctgtccgtcgaggtcaggagaaccgtcgatacccttttgtccggttacacccagcatggcatatcctttcacaaatactccctgttggtcgaaactacttcctgtctgagggtcgatgggactaatatccagatcgttgatacatgaagttactcccgaagagagaactgcgatcagtgcggctgaaaatagctgtttgatatattttgttttcatgataaattgatttaatgaatgttagaattgcagacttaaacctaataagaaagtcatcgctctgggatatggattggcgtcgataccgctttttacttccggatcaaggcctttgtacttgctgataatgaacggattctgtacagtagcatatacacgcccgccaacacctttgtaggtttgagtcttccacagattctggaaagaataacctaacgtgatgttatcacaacgtaagaatgatgcgttatgtataaaatagtcgctcatgtagtaatcaccttgtccgctgaaaccgagtgcgacagcttcggcgctggtgttgctatatgcattattggagtatagtcccgaagtgctgacgttggctttgttgctcaggaagtcatagtacacatagttgttcagactggcacgtaaggagaagctgaagtcaaagttcttatactgcattttggaggtcagtcccatcaaaacatcgcctgccggttttttgtagatatatttgtctccgctgtctatcgttccgtttccgttacggtcaacaaacatattttcaataggtttgccattttcgtcgtatacctgctggtaaacgtagaaggaattggcagcgtaacctactttattcgcctgtaccttggtattgttacctctggaaatcttatcgcctgcttctacgtaataatcgctgtcgtcgccacctgtcaacttggtgatttcattgtggttccatgtaatgttatagctgaggtcccaagtgaagtccttagtcacaatcggtttggcattgatagaaaattccataccgtagttttccagtgaaccgatattctgtgtcatctgggcattgaagttagttcctacgggaatcttaacgctgttcagcaggtcatccgttttacggaagtatccgtcgatgccgcctgtgattcttccattcaggaatccgaagtccagtccggcattccatgtggtcgttttttcccatttcagattttcattgaaagccttcgggcgggaagtagagtaatacgtatcgccaaaaggatactgggcatactcgttattgactacatacagaggaagataagcaaaatcatcgcctatgttttgctgaccggtaataccccagcctaaacgcaatttcagatcagacaggacatttacatctttcaggaagttttcttctttaatcttccatcccagtgccaatgacgggaatgtaccccagcggttatctttggagaaacgtgacgagccatcccaacgcatggtaaaggtaaacaagtaacggttcagcagggagtagttcagacggccgaagtaagagaccagtgtatttctggttgcataagctgtctgttcgcgcaatttggcgtcatggggttcttgcgtataggaatcccagccctggccttcttcaaatccgttgcgatggaagtgctgttcttcaccaccgaccatgatgtcaaagtcgtttgcacccaaagacttgatatattgtacatatatgttgtacgaaaggttgtatttatattgggttacgtcgccgttccaaccataataattattgccgaatgagtatggagaaacaatcgtagtctgcgtaccttccgcatattctccacctatgcttgcgtgcagacggaggtcaggcaggaaatggaatttatagtcaacgtctacatttccaacaaagtcgttgctgtttgccttgtcatttttgagttccagtgcagccagcggattttggggagagttcggattggacgtatatctccagtccggattgctgaaacctgtggtagaattaatattctgccagtagccgcctgtaaactggtaagggtcttcgttagaataaaccggacgggtagggtcgatggccaatgccccgccaatggcggcacctgtatcggcatagcggtttttaccgttcatgaatttggcgttgatgttgaacttcagatgatcttcaaagaaggaaggagccaggttcacggaagcagtgaagcgtcggaagttggatgttttcacaataccattgtcgtctgtataacctaaagatacacggtaaggcaggttcttgaatcctccgttgatagaaacatgatggtcggtgctgacagctgtacggaatatctggtcctgccagtctgtattggcggttcctaaatctgccggtaatttgtcaccccataactgattggcgtaagcgcggtattcgtctccgctcagtacatcataacgtttttgagttttggagaaggatacggagccgttatagcttacgctgggagcttgtccgttctttcctttcttggtggtgataataatgacaccattggatgcacgcgaaccgtaaatggcagttgcagaggcatctttcagtacagtaagggtttcgatgtccgcagggttaaccattgacaaaccgtttgccatccctttgataccttcgttgtcaatagccagaccgtcaataacgatcagcgggtcattgcttgcattcaatgaagaaccgccacgaatacggatttgtgcgccaccgcccggtgtaccgtcattggagatcacgctgacaccggcaattttaccggataacatatcctgagcattcgtcgtaatacctttacttagttcatcgggcttgatagccattaccgaaccggtcatatcgttctttttcacctgaccgtaaccgatgactactacttcgtccagtatttccgtatcgtctttcagtattacattcatttgtgcggcgacgggaagttcctgcggctggtacccgataaatgaaactactattatatcgccttgcttggcagacaactggaagttgccatcgaaatcggtaatcgttccggtggtagtgcctttcaccacaacattggcaccgataaccggttcgcctgttgcgtcttttaccattcctttgacggctatttgttgagcaaatgcgtcaacggacaagaatattccggctataagcgtaagcaggaccttgaacataaagtttccttttttcatgtttttgtctttaaagttaattgtaaaatctctattcattctctcttaagaaatacctattgaaaaccttctcttcgtcatcatttttagtgctcgaaaacactctcttttaccgaataataatttctctgtctttataatctcttgataccttttatctctgatttatcttttacctctttgatgctgatagcatatccgcctccgttagctgcgtgcaggttcagcttgctcttattcgtcagaatacctttcttgatggtataagcctgcgggttctctttccagtcggcatctttggcatccgcgtagacggtagcgatgtattgtttgcccggagtcaggaagtcgaatacgagtttggaggtatgaccgttttcaccggctgtgcaacctacgtaccagtcgtccgtaccttttgccttacgggcaatcgtgatgtattctcccggttctgcttccagatagttcgtttcgtcccagtcgagagctacgtctttgatgaactgaaaagcgtccataaaacgttcgtagttttccggaatgtcggcagccatctgcaaaggactgtacatggtaacgtatagtgccaactggcgtgcaatggtagaacgtacctgagaattgtttgccggattcatcttgttgcaatgcgtttcgaagatgccgggagtgtaatccatcggaccgccaaccaggcgtgtgaaaggcagaattgttgtatgatatactttgttgcctccgaatgattcatattctgttccgcgggcggattcattgccgatcagattcggatatgtacggcagataccggtagggcgggttgcttcgtgtgcattcaccatgattttgtaatcggcggctttcttcactgcatacaggtagtgattgttcatccattgtccgtagtgatgttcgccgcgggggatgatgttgcctacataaccgctctttacggagttgtatccattgtctgccataaactggtaggctttgtccatgtggcgttcgtagttgcgtacagaagcggaagtctcgtgatgcatcatcattttgattcctttgctggctgcatagcggtggatttccttcacatcgaaatcgggataaggagtcacgaaatcaaatacatagtctttgctgttgccgaaccagtcttcccagccttcgttccagccttcaaccagtactgcatcgaatccgtgagcggctgcaaagtcaatgtaacgtttcacgttggctgtgttggcagaatgtttgccgttcggttttgttttggagtaatccgtttcaccgagttttacgctggtcagttcgtcggtgtaagcccatgaaccttttccggtgatcatgtcccaccatacaccgatatatttcacgggttttatccaagaggcggcatccgctatcttgcaaggttcgttcaggttgagagtgatacgtgaagcgaggatattgcgggcgtcatcgctcacgataaccgtacgccaaggtgtgttgcagggagtctgcatatatcctttgtctcctttggcatccggtgtcagccaggattcgaataccatattcttgtcgtccagattgaggtgcatacatgagtaatcaaccaaagcggcttcgtgaagattgatgtataagccatcatccgttttcatcatcagtgcagtttgtacgcctgtctgtgagaaaggagtctgagaagagttcggagtgatcgcttctttcatcagccctctgatttctgataagcgggaaatggtgtagtcatattcctgcgtatcatagtcacccggtatccagaaagcgatatgatcgccgttcatgccaaactgagaatgctcttccttgatcacgaagtaattgagtgacttctgctgaggaaattcataacggaatcccagaccgtcattgaacagacggaaacggataacgatagaacggtcattcatgggttgatacagggtgactgccagttcgttataatgattgcggatttctttttcttctccccaaaccggttgccaggtttcatcaaaagtagccgtttggatatcctttacttcgaagccgtcgtacaggttggtctttgagtcaagttttgtcaggtctctgcggtccacccagtcgaagtcggttctggtattatcttctttcttcagttccagtccgagagtgctgggtttgattaccactttgttcttatacgtcagttcatacgttggggcaccttttgagtctacttggaaggtcattaccagattgttgtccggtgaggttaatttctgttgggcattcgcaatgaatgagatgcaaaggaatgcgatgagcgataaaatctttctctttttcattctatttatggtattaaattataagctaactaatatttttactccgctctgttccggatattgcaaatatagcaaccatcttgagactttgggttgtctagaataaaaatacaagtttgtattaatgttaatgttttgttttacagtagtttatttcttttctgtattctgataaatataagttgaagtgaacttattaaaaggataaaaggtatatttcacgacttggaagtgttaattcatttcttaattcaacctttttctctgtcaataaatcgaaagcagatgaggcaggaagtatttcttggtaaggaaccaggtcaatggtctgttcccggtcgtttccattcaggaaaacaacgactgatttatcaccgtatttgcgttcgtaaacgtagacacctttattcggtgcgaaatgtttgagctgacctttggcaatgacttcgtttccttttctccattggagcagtttttgcataaaggagaatgcttcattttgctgtggagtgcggttggctgcgtcaaagcagttttttgtatcgttcggccagcctccggggaagtcgcagcggagcaggccgtctccattcgccttgtcggctgccatcaggatttcagttccataatatatctgcggtattccgcgggttgtcagtaagaacgtcagggcttgcttgtatcggtccagattctttgtatctgcttccgaacggtagaagcgggaagtatcgtgattgtcgaggaaggtcagcaggctcattggatggctgtagacgatgtcctgtgatagatattcgtagagtctgaaaagtcctccgttccattcggtagtctcttcgtcgaaagccttgttcatctcttccattagcgggaagtccatgacagtcgggagattgctgttcttcggataagcgagtctgctgtctttctgccagtaggagatgagtacattgttgcccagccatgtttcacctacaatgttgaacttgggatattcttcattgaccgctttgcaccagcgtgccatcatatcgaagtcggcataagggtgtgtatcctgacggatgccgttgataccggcgtattcaatccaccagatactgctctgtatcagataagtagctacatgacggtttctttggttgaagtccggcatggtcagtgtgaaccaaccgtcgatagcgattttcttttcgtaatcggaagcatacgggtccatttgagtggcagtcttgaagctggtctgcacgtagttgccttcaaagttaaaccagtctttggagggcatatctttaaacagatagttgtccgaaccgcaatggttgaagatcatgtccattacgactttcagccctttggcattagcttcctgagtaagtttgcggaactcttcgttactgccgaagcggcggtctacctgataataatcggtaatggcataaccgtgatacgatccttctttcatgtcattttcctgaatcgggttgagccatatactggtgactccgaggtctgctatgtaatccagatgattctctattcctttcaaatcaccgccatgacgtgcgaaaggctcattacggtctacatttccttccagcattccgggaatgatgtcgttggaggggttgccattggcaaaacggtccggcataataagataaagcacgtcgctcgaatcaaaaccttctactgccgaagcattcggccggcgctgtttaagctcgtaagggatttttgtctgctttttgccttgtttcaggatgatgtcaaagttctgtggagcagccttcgaaaggtctaaatacagaaccagataattaggattctcctgcttcaccacttcttgcagcgtgatattatcggcagaaagactgacgtctgcggatgatatgcggtcaccatataatagtatctgcaattcgggattcttcattcctgcccaccaaaaggtcggggctactttctttatagtgcttgttgcgaatacctggtgaagaccgggtaataataatagtaagataatgaataataaattccttttcatggtaactagatttttaaaatttgttcgggggaaccgatgatgcaaatgtaggtgaatcgggtatgccgtatggcagttagaaagaaaatataaatgcttgttttgaataggctgttgataataagctttttatcgttattgcctctgtcgaaaaatacaagtgaaaatgaaaattgttatggcgatatttttcgtttttattactataatcattatatttgtcacatcttaaaaaagcaccttatgagaaatctaacctattatcttttgtttcttctttttgtttatcctctttccttgtccgcaaagcatacggatataaataaggcggcccttaaaaaactggatgacattataagtaagaaggaaacttatcagatacggagagaaaaagacattactgatttaaaagtacaacttgcccattccaccgatcctgcccggaattatgagttgtatgcctccctctttggggcttaccttcattatcaggcagattcggcgcttcattatattaaccgtcagatggagatattgccccaattaaatcgtccggacctggaatatgagattgtcattaaccgtgctacggtaatgggtgtaatgggcatgtacatcgaagctatggaacaattggagaagattgatcctaaaaaactgaatgaatggactttgctttcttattaccagacctatcgcgcctgctacggctggctcgctgattatacgacaaacaaaaccgaaaaagaaaaatacctgaaaaagaccgatttgtacagagattccattatcgccgccatgcctccggaagaaaataaaacgattgttatggcggaacgatgtatcgtgaccggaaaggccgatacggctatcggcatgctgaacgatgcactgaaagatatggaagacgaacgtcagaaagtatatatctattataccctttccgaagcatatagcatgaagaaagacgttgagaaagaagtttattatctgatactgactgctattgcagacttggaatcttccgtcagggagtatgcttccttgcagaaactcgcgcatctgatgtatgaactaggggatattgaccgtgcttacaaatatctgagttgttcgatggaagatgctgtagcatgtaatgcccgtttgcgatttatggaagtgacggagtttttcccgattattgataaggcttataaactgaaagaagagagagaacgggccgtttcccgtgccatgttgattagtgtcagtctgttgtcgctgtttctcctcattgctattttctatctgtatcgttggatgaagaaaatatccgtcatgcgtaggaatctaagtttggccaacaaacaaatgtctgcggtcaacaaagaattggaacagaccggaaagataaaggaagtatatattgcccgttatttggacagatgcgtcaattatctagataaactggaaacttatcgccgctctctggccaaacttgctatgtcgtcacgtatcgatgacttgtttaaagcaatcaagtccgaacagtttatccgggacgagcggaatgaattttataacgaatttgataagtcattccttaaactgttcccacactttattacttctttcaataatctgctggtagaagaagcaagagtttatccaaaatcagacgaactgctgacaaccgaactccggatctttgcccttattcgtttaggagtagtggatagtaacaagattgctcattttctgggttattctttggcaactatctataattaccggagcagaatgcgcaataaagctgccggagataaagatcggttcgaacaggatgtaatgaatttgtaagtacactctagtctctcttcatgtctccaatagacataggtatgatatgactaattgattgtatatgaatggcttagagtttccatgaatttcctgctttggaaactgtcgtttcccggtgtgggaacgatcgtttcctttaaaggtaactctcgtttctcggtgagggaacgcccgtttcctaacgggatgatgtgtactggttttagttgacaacttcgtttgttataactgaattagtttacaggcggaatatacattgatcaatgaactgtcttttgagaagaagctgcctaatctatgtactgtcattaacggtgtagacctgaagaagagaaaatatggttattactacggctacggcaagtatggcaagcattatggctatggtaaacgttatggttacggctatggatatggtcaagatacaaaaagataaatatctgaatatctatgaattataacttttctcagaaaaagagccccgcaaggggcttttctttttgttatctgaaataaaagcctcacctttgcattgttgatcaacaaaacgtgaataaaataacttgaatttgaatctttaaaaaaacgtattatgagtgtaatttacaaggttgttacgcgaccatctgacccgcgtgttcccaattctcccaagaaatattatccgcatctgatcactttaggtcagtctgtcaatctgaaatatattgcgcagaaaatgcagggctattcttctttatccatcggtgatatcaagagtgtgattcagaattttgtggagaaaatgaaagagcaacttctggaaggtaagtctgtgaatatcgaaggcttgggtgtatttatgctgactgcttgttcgaaaggggcggatgcagcgaaagatgtcaatgctaaaagtgtggatagcgtacgcatcttctttcaggcgaataaggaactgcgtatcacgaagacggctacccgtgcagatgaaaaactggatttgatcagtttggatgaatatctgaagaagttgaatgcctctgtgactccgaatgatccggatgatggtgaaaatggcggtggtggaaatgaaggaggagatgaggaagccccggatccgactgtataatctgaaaagcttaaaaagaaaggaggaaaaatctatgaagaaaacttggagtgtagttttgaaagtaatcattgctgtagccggtgcgattgccggagtactgggagtacaggctgcatcattgtaagcagcattcagtaaataaagtaattggttagataagacaggcaggcgggaagaactttcccgcctgctttgttgtatgctaaaatatcaaatagttggcgttactttttcgtgtgcgataacgaaaacacaaaaaataacattttattatgtagaaaaaaatgagggaatgcttcgtagttcacaaataatgattaaatttgccgcgatttgtaatgttgagtttgcaaaatgacgaataatactataaagcatctaggtattgtggaaaacatacagggttctcatctgtcggtgagaatcgttcagacgtcggcttgtgcggcttgtagcgcaaaaggacactgttcttcggcggatagtaaagacaaaatcatagatataacggatgttacagctgcttcctatcaggtaggagagcgggtgatggtgatcggcgaaacgtcgatgggcatgatggctgtaacccttgcattcataattccttttgtacttctgattgtttccctgttcgcatggatggcgttgatagggaatgaactgtatgcggctcttctttctctggcagttcttattccttattatttcgtattgtggctcaataaaacgcgaatgaaacaacatttttcatttactataaaaccaataaataactaaaacattatgaatttgattctgattgcagtgatttcattgggagctatagcgctcgtgctggccgctattctttatgtagcttccaagaaatttgccgtgtatgaagacccgcggattgcccaggtgggggaagtgttgccccaggcaaactgtggtggatgtggctatcctggttgtagcggatttgccgatgcttgcgtcaaagccggttcgctggatggtaaattctgccctgtaggcggtcagcctgtcatggcacaagttgctgatattctcggactggcagctactgaagctgaaccgatggtagcagtagtgagatgtaacggaagctgtgccaaccgtccgcgtattaatcaatacgatggtgcgaagagttgcgctattgccgcttcattgtatggtggagaaacaggttgtagctacggatgcctcggatgtggcgactgtgtggctgcctgccagtttgatgctatccacatgaatcccgaaacgggacttccggaggtggatgaagccaaatgtacagcttgtggcgcttgtgtgaaggcttgtccgaaggcgatcatcgagattcgtccgcaaggcaagaaatcacgtcgtgtgtacatctcttgtgtgaacaaagacaagggggccgtagcacgtaaggcttgtacagtgagctgtatcggctgtggtaagtgtgtcaagacttgtccgttcgaagccattacgctggagaacaacctggcttacatcgatccgaacaagtgtaaatcatgccgtaagtgcgtggaagtttgtccgcagaacacgattatcgagctgaacttccctccacgtaaaccgaaggcggaagaagctccgaaaacagttgctgcagaagctccgaaggtaacagaataataacagaataaaatacagaattgtatgttaaagacattttcaattggtggagttcatccacacgaaaataaattgtcggcacatcaacctatcatcacggcggaagttcctgcgaaggcagttattctgttggggcagcacattggcgcacctgccaaaccggtagtagcaaaaggtgatatggtgaaggtaggcacgaagattgccgagcctgccggcttcgtttcggcagcaattcactcttctgtcagtggaaaagtggcgaagattgatacagtagtcgatgcgagcggttatgcaaaacctgctatctttattgatgtagaaggcgatgaatgggaagaagccattgaccgtagcaagacactggtcaaagaatgtgagctttcgtctgaagaaatcgtgaagaagattgccgatgccggtatcgtaggtttgggtggtgcttgtttccctacacaggtgaagctttgtccgcctccttcgttcaaggcagaatgtgtgattatcaatgcggtggaatgtgaaccgtatctgactgccgaccatcagctgatgctggaacacgcggaagaagtcatggtaggtgtctctattctgatgaaagccgtgaaggtgaataaggcatttatcggaatcgagaataacaagccggatgctattgaactgatgacgaaagtcgcttccagttatgcaggcatcgaagttgttcctttgaaagtgaaatatcctcagggcggtgagaaacagttgattgatgcgattaccagacgccaggtggcaagtggtgcgctgcctatctctacaggagcagttgtgcagaatgtgggtacggcattcgctgtttatgaagccgttcagaaaaataaaccgttgtttgagcgcgtgattaccgtaactggtaagtctgtggccaaaccttccaacttcctggctcgtatcggtacaccgatgaagcagctgattgatgcttgcggcggtctgccggaggatacgggaaaggtgatcggcggcggtccgatgatgggtaaggctctggtgaatatcgaagttcctaccgcaaaaggtagctccggcatcctgatcatgaatcagaaggaagccaaacgtggtgaagcacaaacctgtatccgttgtgcaaagtgtgtgagcgcttgtccgatgggactggagccgtacttgctcggagctttgtccgaaaacggagattttgaaacaatggaaaaagaaagaatcatggattgtatcgagtgcggttcctgtcagttcacttgtcctgccaaccgtccgctgcttgattactgccgtctgggtaagggcaaagtaggaggcatgattcgtgcacgtcaagctaaaaaataacgaagtatggaaaataaattaatcgtatcactatcaccccacgttcatggcggagacagcgtacagaaaaatatgtatggcgtgctgatcgcactgattccggcttttctggtgtcgctttatttcttcgggctgggggctctgattgtcacggctacttcggtagcagcctgtttattcttcgaatgggcgatcgttaaattcttaatgaagaaacctgctacaaccatctgtgacggttctgctgttattacaggtgtgttgctggcattcaatttaccctccaatctgcctgtctggattatcattctgggtgcactgttcgcaatcggtgtaggcaagatgtctttcggtggtctgggctgcaacccattcaacccggcattggcgggacgtgtattcctgttgctttctttcccggtgcagatgacaacatggccggtagtaggtcagctgacatcttatatggacgctaccaccggtgctactccgctggcattgatgaaacaggctattcacggcgatgcaagtgctttgagccagatacctgatgcgctgactctgtttatcggacagaacggcggatgtatcggtgaagtaagtgcgctggcactgttgctcggactggtatacatgctctggaaaaagatcatcacctggcatattccggtttctatcattgtgactgtatttgtatttgcaggcattatgcacatggtggatcccgaaaagtatgtttctccggtattgcaactactctccggaggtctgatgctgggagctgtctttatggcaaccgactatgtgacttctccgatgagcaagaaagggatgctgatttacggtgtttgtatcggtctgctgacggtggttatccgtctgttcggtgcatatcccgaaggtatgtcattcgccatcctgattatgaatgcgttcactccgctgattaacacctattgtaaacctaaacgctttggggaggtagcgaagaagaaatgaaaaagttacaatcatctttaaagaatatgttgctggtacttacgggcgttacagccgtttccgtagcgttgctggcttatgtgaacgaactgacgaaaggccctattgccgaagcgaatgcaaagacgctgaacgaggccttgaaaaaggtgcttcctgaatataccaataatccggtagccgaaagcgatactgttttcagcgagaaagacggaaagaaaatcgtggatttcattatctatccggccaagaatggcgaaaagtgggtaggttctgccgttgaagccaagtcaatgggatttggcggtgaactgaaagtgctggtgggctttgatgctgaaggcaagatttataactactctttattggcgcacgctgaaactccgggattgggttcgaaagcggacaaatggtttggagcttatgatcctgcaaagaacgaaaaaccggtatctcacgaagaaagtgcaaagtctattttgggcatgaatccgggagagactccattggctgtgaccaaagacatgaatggacaggtagatgctatcacggcttctactatcacttcacgtgctttcctgaatgcggtgaatgctgcttatcaggcatataaaggcggtgaggtggatacgaattccggagcttcccagaaaaatgaaccggctgttgcgccggaaggtgaagcagctgctaatgacactaataactaagaaaggaggagacagttatgaataattttaaagtaatgatgaacgggattatcaaagagaatcctatttttgtgctcctgctcggtatgtgtcctacactgggtacgacatcatcggcaatcaacggtatgggtatgggactggccactatgttcgtcctgatttgctcgaacgtggtaatttcatctatcaagaatctgattccggatatggtacgcatcccttcatttatcgtggtgatcgcgtcattcgtgacactgttgcagatgataatgcaagcatacgtgcccgatctgtatgctaccctcggtcttttcattccgctgatcgtagtaaattgtatcgtattgggacgtgcggaagctttcgcagcgaagaacaatccgctggcttctatgtttgatggtatcggtatgggatttggttttaccattgccctgactctgttgggtgccgtacgtgaattcctcggaacaggtaagatatttaatctgaccattctgccggaagaatacggaatgctgatctttgttctggctccgggtgcctttatcgctttaggttatctgattgccattattaatagtctgaagaaagcctaactctattaaataagaaaagaatatggaatatatattgatatttatctcggcaatctttgtaaacaacattgtgttgtcgcagttcctgggaatctgtccgttcctgggtgtttccaagaaggtggaaacagcgatgggtatgagtgcggcagttgctttcgtgctgactatcgctaccatcgtcacattcctgattcagaagtttgtgttggacgctttcggattggggtacttacagacaatcacttttattctggttattgccggactggtgcagatggtagaaattattctgaagaaagtttctccttctttgtatcaggcactgggggtgttcctgccgttgattacaacgaactgctgtattctcggtgtggcaatcctggtaatccagaaagactttgatctgctgacaggtgttgtatacgcattctctactgctcttggctttggtctggcactggtattgtttgccggattgcgtgagcagatgaccctggtgaagattccgaaaggaatgcaggggactccgattgctttgattaccgcaggtttgctggcaatggcattcatgggcttctctggcgtcgtgtaaaagactaagttgataattagataaagaggctggaaactctgtcgtatggcaacatacaggcagtttgtttccggcctttttctttatatctgttcataccgaatatgttttttatcataccaaaacgccctcaaatcgtcccgtaagtatcttcctgtgaataaaattgcgatagtttattgcatttccattttatttccatacatttgtacctcaaacaaactgaaaaccgaaaaactaaccatattttaaaattatatgaaagaaagaattttagtaacgggaggaacaggctatattgggtctcataccgttgtagaactacaaaacagtggatacgaagtaatcattatcgataatttatcaaattcgagtgctgacgttgttgacaatatagagaaagtatccggtatccgcccagcttttgagaaactggattgtcttgattttgctggccttgatgccgtatttgccaaatataaaggaattaaagcgattattcatttcgcagcaagcaaagcagtaggagagtcggtagagaagccgttgctttattatcgtaacaacctggtttctttaatcaaccttctggagttaatgcctaaacatggagtagaaggcatagtgttctcttcttcctgtacagtatatggtcaaccggatgagttgcctgtaacggaaaaggctccgatcaagaaagcggaatctccttatggaaatacaaaacagattaatgaagaaattatccgtgatacagtagcttccggtgccccgatcaatgctattttgctgcgttatttcaatccgattggcgcacatcctacagcattgttgggtgaacttccgaacggtgttcctcaaaacctgattccttatctgactcagacagcgatgggtatccgtgaaaaactaagtgtattcggtgacgattatgatactcctgacggttcttgtatccgtgactttatcaacgttgttgacttggctaaagcacacgtgattgcaatccgccgtattttggagcaaaaacagaaagaaaaagtagaagtattcaatatcggtacaggacgcggcgtttcagtattggaactgattaatggctttgaaaaagctaccggcgttaaattgaattatcagattgtaggccgtcgcgcaggtgatattgaaaaggtatgggctaatcccgattatgcaaaccaggaactgggttggaaagcggtagaaacattagaagatactttacgctctgcatggaattggcagctgaaactccgtgaaagaggcattcagtaaaaagatatttgttttaattaacataaaagtttaaacaaatcgttcatgcgatttgtttattagatgctaatcagcttgatctgtttgtgagtatgtgaatatgagtaaatggtacttatgcctctccggcatagacaggtatgattgcatagtagttttgtcgtgttttattttgtgtttgtgttgtgacggtactacgacgggagtcgtggtaccgttttttgttactcttttatagcctgcctttaaaacagaatacgttagttccccaatcggtttcaggtaaagttccttccggctcgaacaatccgtatacggaagaaccggaaccgctcatagaggcataaacagccccttgcctgtatagctcggctttaatttctccgatcaccggatgctgggggaatacgctgtcttcaaaatcattgattaatatctctttccattcatttaccgggcgtttaatcgcttctttgatcgagtattcgggatgatgagggtgaatattggcgaaagcttcccgcgttgatacgaatacatccggtttgatgatcagaatcttatatccttttaaggatagtggaatgggggagaatatgttgccgattccttcggcaaaggtcggggcgtttttgataaagaaagcgcagtctgctcccaaagttgcggcatatatttccagctgatcttcggataaattcagctgaaagtgttcgttgagtaatttcagcatgaaagccgcgtctgatgagcctcctcccagtccggcaccggaaggaatgtgtttgtacagatggatctcgataggacagaggtgaaactctttatctaatagcagatatgctttcaccactaaattgtcttctggattaccggatatctccattccgtactgatgcagggagaactttttgtccgcttcggggctggtccggatttccagcgcatcttcgagagcgacggggtagaatacggtttcgaggttgtgatatccgtccggacgcttctcggtaatagagagtcccaggtttatttttgcgtttgggaaagtgatcatattcgttctgaattattatttttgaattttaaattatgggttgcgaatttatgctattggtgacaaagttactaaaatcttcatttttccttatcttttcttcattattatattctatctttgtcatccctttcggcttttactatgtataaaagccggggatcataaattgtaaatcataaaattgtatataagcagatggctgaacaaagaagaaattcccgtaacacaaaatcaactaaagtacaaccggtcaatgattatggtcgtatccaacctcaggcaccggagctggaagaggcggtgttgggtgctttaatgattgagaaggatgcttattcgctggtgagtgagattcttcgcccggagtcattttatgagcatcgtcatcagttgatttatgctgccattactgatcttgccgttaatcagaagccggtggacattctgacggtcaaagagcagttgagcaaaagaggtgagttggaagaggtcggtggaccgttctatattactcagttgagcagtaaggttgcttcttccgcacatatcgaatatcacgcccgtattattgcacaaaaatcgttggcgcgcgaattgataacgtttaccagtaatattcaaagcaaggcttttgatgagacactggatgtggacgacttgatgcaggaggcggaaggcaagctgtttgagatttcccagcagaatatgaagaaagactatacgcagattaatccggtaattgacgaagcgtataagctgattcagaaagcggctgcacgaacggacggtctgagtggtcttgaaagtggatttacgaaactggacaagatgacctccggttggcagaactccgaccttattataatcgctgcccgtcctgccatgggtaagacagctttcgtactttctatggctaagaatattgctgttgattatcggaatccggtagcgttgttctctcttgaaatgagtaacgtccagttggtcaaccgtcttatcaccaatgtttgtgagattccgagtgagaagatcaaaagtggacaattggcaagctatgagtggcaacagttggactacaaactgaaagatctgctggatgctccgctttatgtggacgatactccgtctttgtctgtgtttgaactccggaccaaagcacgtcgtctggtgcgtgaacatggggtgagaatcattattattgactaccttcagttgatgaatgcgagtggtatggcattcggtagccgtcaggaagaggttagtacgatatctcgttcgttgaaaggattggcgaaggagttgaacattcccattatagccttgtcgcagttgaatcgtggtgtggagagtcgtgaaggtattgacggtaaacgccctcagttgagtgacctccgtgaatccggagccatcgagcaggatgccgatatggtgtgttttattcaccgtccggaatattataagatttatcaggatgatcgtggtaacgaccttcgcggtatggcggaaattgtgatagccaagcatcgtaatggtgcggtaggtgaagtcttgctccgattcaaaggtgagtttacacgattctctaatccggaagatgatatggttataccgatgccgggtgaacctgcaggtgccatgctggggtctaaactgaatgccggtgctatgcctccgcctccgccggaaccggactttgttccgcagggaaataatccgttcggtgcaacggaagggccgttacctttctaaaaaaacgttcgtttgggttgaatagaatgaccgcttagtcagatgaaaataaccgctcgatttactccaatcgagcggtcgattattttttatagagtatagccaagttgtattctgatggggataggtggcaaaaatgacaaagaatacccctttattttttgccactttgtcaccaaccatgaatttattggggaataatacagtcaggtccttgttagtttagcttctcttgacatttttctctcaaatcgttctatgtcaaccgaaaaatcttattaactttgcgaaactttttgagaaacaataaaaatttaattatatgaatatctcttataactggctgaaagagtatgtcaactttgatttgacccccgatgaaacggctgctgcgctgacctcaatcggcttggaaacaggtggtgtagaagaagtgcaaaccattaagggtggtttggaaggactcgtaatcggtgaagtgctgacttgcgaagaacatccgaattccgaccatttgcatatcactaccgtcaatctgggagacggcgaacctgtacagattgtatgcggtgctccgaatgtagctgccggacagaaagtagtggttgccactttgggtaccaaactttatgacggtgatgaatgctttactatcaagaagtcaaaaatccgtggtgtagaatctacagggatgatttgtgcagaagacgaaatcggtattggtaccgatcatgcaggaatcatcgtgttgccagctgaagctgttccgggtactctcgccaaagactattataatatcaagagtgactacgtactcgaagtagatattactcctaaccgtgcagacgcttgctcacactatggtgtggcccgcgacttgtatgcttacctgattcagaatggcaagcaggctactttgcaacgtccatctgtagatggatttaaggtggaaaatcatgatttggatatcgaagtagtggttgaaaacagcgaagcctgtcctcactatgccggcgttacggtgaaaggcgttactgtgaaggaaagccccgaatggttgcagaataaattgcgcctgatcggtgtacgtcctattaataatgtagtggatattactaattatatcgttcatgctttcggtcagccattgcattgtttcgatgccggaaagataaaaggcaatgaagtaattgtcaagacattgccggaaggcactccattcgtcacattggatgaagtggaacgcaagttgaacgaacgcgatctgatgatctgcaacaaagaagaagcgatgtgtattgccggtgtattcggcggactggattccggttctacggaagctacgacagatgtatttatcgaaagcgcttatttccatcctacatgggtgcgtaagactgcccgtcgtcacggtctgaatacggatgcttctttccgtttcgaacgtggcatcgatccgaacggagtaatctattgtctgaaactggctgctctgatggtgaaagaactggccggtggcactatctcatccgaaattaaggatgtttgcgttgcagctccacaagactttatggtagaactttcttatgagaaagtaaattcgctgattggtaaagtgattcccgtggaaacgatcaagagcattgttaccagcctggaaatgaaaatcatgaatgagacagttgacggactgacattagccgttcctccttatcgtgtagacgtacagcgtgattgcgatgtgatcgaagatattctacgtatctacggatataataatgtagaaatcccgactacgctgaactccagtctgacaaccaagggtgagcatgataaatcaaacaaattacagaatctggttgcagaacagttggttggctgtggcttcaatgaaatactgaataattctctgactcgtgccgcttactacgacggtctggagaactatccatccaaccatctggtgatgctgctgaatccactgagtgccgatctgaactgtatgcgtcagacattgctgttcggtggactggaaagcatcgctcacaatgcaaaccgcaagaatgccgatttgaaattcttcgaattcggtaattgctattacttcgatgcggacaagaagaatccagaaaaagtactggctacctattcggaagactatcacttgggtttgtgggtgactggaaagaaagtagccaactcatgggcacacccggatgaaaacagttcggtatacgaattgaaggcttatgtagagaatatattgaagcgcctgggactggatttgcacaacctggtagttggcaatctgactgacgatattttcgctaccgcactttctgttcataccaagggggggaagcgtcttgcctctttcggtgttgtgacgaagaaactgctgaaagcattcgatatagataatgaggtgtattatgccgacttgaactggaaagaactgatgaaggctatccgttcagtgaagatcagctacaaggaaatttccaaattccctgctgtgaagcgtgacttggcattgttgctcgacaagaacgtacagtttgccgaaatcgaaaaaatcgcttacgatacagaaaagaaactgctgaaagaagtggaactcttcgatgtatacgaaggtaagaacatcgaagcaggtaagaaatcgtatgcggtcagcttcctgcttcaggatgaaactcagacgctgaacgataagatgatcgataagatcatgtctaaactggtgaagaatctggaagataagctgaatgcaaaattgagataaatttaaaattcacaattcaaaattaatacaaaccaatgggaagagcatttgaatatagaaaagccgcaaagctgaaaagatggggccacatggctaaaacatttacaagactgggtaaacagatcgctattgccgtgaaggcgggtggtccggaaccggaaaataacccgacactgcgttcggtcatcgctacttgtaagcgtgagaatatgccgaaggacaatatcgaacgtgcgattaagaatgcaatgggtaaggaccagagcgactacaagagcatgacttacgaaggatacggtcctcacggaattgctgtctttgtagatacgctgactgataatacgactcgtacggtagccgatgtacgctctgtattcaataaatttggtggtaacctcggaacaatgggatcattggctttccttttcgaccataaatgtatgttcactttcaagataaaggacggcatggatatggaagaactgatccttgatctgattgattacgacgtagaagatgagtacgaacaggatgacgaagaaggaacaatcactatctacggtgatcctaagagctatgccgctattcagaaacatcttgaagagtgtggcttcgaggatgtcggcggtgattttacttatatcccgaacgatctgaaagaggtaactccggaacaacgcgaaactttggataagatgatagaacgtcttgaagaatttgatgacgtgcagactgtttatacaaacatgaagccggaagaaggcggaaacgaggagtaagcggattatggaatatgtttatagaacccagggtacttgcagcacaaacatcgaactgaatgtagaagatggagttgtgaaggaagttgccttttggggaggatgtaacggaaatcttcaaggactttcacgtctggtaaagggaatgaaggtagaagaggttatcaagaaacttgaaggagtacgttgcagtggcagaccgacgtcctgtcccgatcagttgtgccatgcactgcatgaaatgggatattaacggaagtctccctttataaaatatacactggcctccggcaattcattttgccggaggttttttattgtgccgtacctttccctatttgtcggtattttgaaccaaaatcgaccttcggtcgttatttataagtatatttgtgctgaataaactattatgcaatgatgaagaatatttttcaagacttaaaacggaaagatcataaacgttatctgggcggactggatgtttttaaatatattggtcccggacttttggtaactgtcggatttattgatccgggcaactgggcatcaaattttgccgcaggttccgagttcggctattcacttctttgggtggtcaccttatccactatcatgttgattgtcctccagcataatgttgctcacttggggattgttacggggctttgcctttcggaagccgctacgaaatatactcctaaatgggtatcccgtcctattttgggtacggcggtattggcgtctatttctacttcattggctgagattctgggaggagccatcgcattggagatgctgtttgatatgcctattatgtggggggcggtgctgaccacactttttgtctccatcatgctctttaccaactcctataaaaagatagaacgttccattattgcttttgtctcggtgatcggtctttcatttatttatgaattgtttctggtagaaatagactggccggctgcgacgatgggttgggtgacgcctgctttcccgaagggtagtatgctgattattatgagtgtgctgggagcggttgtgatgcctcataatctgtttctgcattcggaagtaatacagagtcacgagtataataagaaagacgatgcgtctatcaagaaagtattgaaatacgagttgttcgatacgcttttctcgatgatcgttggctgggcaattaacagtgctatgattctgctggctgctgctactttctttaaaagcggcattcaggtggaagaattgcaacaagccaaatcactgcttgaacctttgttgggaagtaatgcggcaatcgtattcgcattggctctgttgatggcaggtatttcgtccactataacaagcggaatggcggcaggttctatctttgcaggtatctttggagagtcatatcatattaaagacagtcactcgcaggtaggagtaatcctttcgttgggaattgcgctgttgctgattttctttattggcgatccattcaagggattactgatttcgcagatgatattgagtattcagttgcctttcacggtattcctgcaagtagggttgacttcatcccgaaaggtaatggggaattatgtcaatagccgttggagtacttttgtattatatgctattgcagtcattgtttcggcattgaatataatgctgctgttttcataaaacgaacataaatctataaactataaaatgatgaagattattacttataatgtgaacgggcttcgtgctgccgtttctaaaggtttgccggaatggctggtgcaggagaatccggatattctttgtctgcaagagacaaaactacagccggaccaatatccggcagaagtatttgaagctttgggttacaaggcttatctctattctgcacaaaagaagggatacagcggtgtggcgatccttactaagcaggaacccgatcatgtggaatatggtatggggatagaagcttatgacaatgaagggcgttttatccgtgcggattttggcgacttgtccgtagtcagtgtttatcatccttcgggaacgagcggagacgaacggcaggcatttaaaatggtgtggctggaagactttcagaaatatgtgacagagctgcgcaagactcgtccgaaccttatcctttgcggtgactataatatctgtcatgagccgattgatattcatgatcctgtccggaatgccacgaacagcggcttcctgcccgaagaacgggaatggatgactcgtttcctttctgcaggatttattgattctttccgtctgctctatccggagaaacaggagtatacgtggtggagctatcgttttaattcgcgtgccaagaataaaggctggcggattgactattgcatgaccagtgagccggtacgtccgatgctgaaaagtgccagcatactgaacgatgccgtacattcagatcattgtccaatggctttggaaatagaataaaaatagaaaatagcatggaagatagaatacaaaaagctgtagaactttttaagagcggatataactgctcgcagtctgtagtagctgcatttgccgatatgtatggtttcacacaggagcaggcagtgcgtatgtcagcctcttttggcggaggaatcgggcggatgcgtgagacatgcggggctgcttgcggactgttcctgatagccggactggaaaccggagctaccgaagcgacagatcgtgaaggaaaagctgcaaactatgcggtagtgcaggaattggctgccgaatttaaaaaacgcaacgggtcgttgatttgcggagaattgttgggattaaagaaaaaagagccgatttcgactgttcccgaagaacgtaatactcaatattatagcaaacgtccgtgtgctaaaatggtggaagaagcggcaagaatctgggtagaatacctcgaaaaacaccctaaataaggggataaaatgcttttttattacaaaatcagcaaaaaaagattcaataaagtgttatataacataaaaataactatctttgtccccgaaataaaatctgaaagctttcgggccggatgatttttaaagcatgtctaactataatttcaaaagcaaatgttgaaagaaaaagcaggtgtaatcgcaggtaatatctggaatgcactgaatgaaacagaaggaatgactgccaagcaactgaaaaaagcaactaaattggttgacaaagatttgttcctcggccttggctggttattgagagaagataaagtttctgctgaagaagtagaaggtgaactcttcatcaaattgatctaagcgagtaactcacttaagcaataaaaaaatgcgttggtacatgattataatgttatcaacgcatttttttatattccgccatttacgtatctttgcacaccaaaaagacaaaataataagaattcagaatgaagaatatacgaaatttctgcatcattgcccacattgaccacggtaaatcaaccctggcagaccgcttgctggagtttaccaacactattcaggtgactaacgggcagatgcttgatgatatggatttggagaaggagagaggtatcaccatcaagagccacgctatccagatggagtacaactacaaaggtgaaaagtatatccttaacctgattgacactccggggcacgtggatttttcgtatgaggtatcccgttccattgccgcttgcgaaggtgcgctgcttatcgtagacgcatcgcagggagtgcaggcacagaccatctccaatctgtatatggctatcgaacatgatctcgaaattatccccattatcaataaatgtgatatggcaagtgccatgcccgaagaggtagaggacgaaatcgtagaactgttgggctgcaagcgtgatgagattatccgtgcatccggtaagaccggaatgggcgtggaggaaatcctcgcagccgttatcgaacgcattccgcatcccgaaggtgatgaggaagctccgttgcaggcattgatttttgactctgtattcaactccttccgtggtattatcgcttactttaagatcgaaaatggagtaatccgcaagggagataaagtgaagttctttaataccggaaaagagtatgatgccgatgaagtaggtgtactgaaaatggaactggttccacgtaacgaacttcgtacgggcgatgtaggttacattatatcgggtatcaagacctcgaaagaggtgaaagtgggagataccattactcatgttgcccgtccgtgtgataaagcgattgcgggttttgaagaagtgaagccaatggtttttgccggagtctatccgattgaggcggaagattttgaggatctgcgtgcttctttggaaaaattgcagttgaatgacgcttcgctgactttccagccggaatcttcattggcactgggcttcggtttccgttgcggtttcctcggattgcttcacatggagattgtacaggaacgtctggatcgtgaattcgacatgaatgtgattactaccgtgcctaacgtatcttataatatatatgataaacaaggcaatatgaaagaagtgcataaccccggtggtatgcctgatccgacgttgatcgaccatattgaagaaccttatatcaaagcgtctattattacgactaccgattatatcggcccgattatgaccctctgtctggggaaacgtggagaactcttgaaacaagagtatatttccggtaatcgtgtggaaatatattataacatgcctttgggtgaaatcgtgatcgacttctatgaccgattgaagagtatttcgaaaggatatgcgtcgttcgactatcatcccaatggtttccgtccttccaagttggtgaaactggacatcatgttgaatggtgaaccggtcgatgcgctttctacgctgattcacttcgataacgcgtatgatatgggacgccggatgtgtgagaaactgaaagaattaatccctcgccagcagtttgaaatcgctattcaggcagctatcggggctaagattatagctcgtgaaactattaaggcagttcgcaaggatgtaactgcgaagtgttatggtggtgacgtaagccgtaaacgtaaactgcttgaaaagcagaaaaagggtaaaaaacgaatgaaacaaatcggtaatgtggaagtgccgcagaaagccttcctcgccgtactgaagctggattaaaaaatgaaccgcaagcgatttttcagagagttattctgaacaaatcggcttgcggttagttttttaatacaccaggtgattgtcttctgtctgcagagctttccttggcaatcaccttttttgaaacaaacaactataaatatgagaaaagttctgtctttttcgggcttcctgatgttggggctcgtcatttcacaattcctcccgatgatagcgggagaaggatatggaactgttaaggtcctgtcgaatatactactttatgtatgtcttagttttataatgattaatgtgggtcgggagtttgtgctcgacaaagtccgctggaaaagttatgccgaggattatcttatagcgatggctacagctgccctgccttggttcatgattgctatctattatgtattcgtgcttcttccgcctgattactggaatagttgggaggcttggaaagagaatctgttactaagtcgttttgccgcacctacgtcggccggcatcttgtttacgatgctggcggctatcgggttaaagtccagctggatatataagaagattcaggtcctggctatttttgatgatctggataccattcttttgatgatccctcttcagatcatgatgattggtttgcgttggcagctgattattgtggtggttattgtatttatgctgttgtccattggatggaaacaactgaataagtataactggcggcaggattggaaagctattctcttctattccgttatcatatttctggctacgcagatactttatctcggcagtaaagagctgtatggagaagaaggaagtatccatatcgaagttctgttgccggcatttgtattgggtatgatcatgaagcataaagagcacgatactcctgtagaacgaaaagtctctactggaatctccttcctgtttatgttcctggtaggtatgagtatgcctcattttatcggagttaactttgcggaaactcatacaggaacgcattcggtgacaggttcgcaggagatgatgtcctggggaatgattttgttccatgttgtcatagtctctttcttatcgaatataggcaaactttgtccgatgttcttctatcgtgaccggaagttgagtgagcgactggccctttccattggtatgtttacccgcggtgaggtaggtgccggaattatatttattgcattgggttataatctcggcggtccggcactggtcatttccgtacttacattggtgttgaatcttattctgacaggaatatttgtcctttgggtgaaaaacttggctttaaggagctataatgattaaaaaaatccatatattgcggatcaaatactataaacacctttcattatgacaattttgcgtacaatgcgaaatttctcgtcaatgaatattgcggcgagtatccttttgtttgtagcggcaatagcggctgctatcatagccaattctccggttgctccggtttatcaggagttccttttgcatgaacttcatttgcagatcggtaattttaatctgctttcgcatggcggagagaatctgcggatgatcgagttcatcaatgacgggttgatgaccatctttttcttgctggtaggattggaaatcaaacgggagttgttggttggtgagctttcttccttccgcaaggcggcgcttccctttattgctgcctgtggcggtatgctgtttccggtgattgtttacatgtcaatctgtcctccgggcagtgcgggaagtcagggattggccattccaatggcaacggatattgctttttcgttaggggtattaagtctgttgggaagccgtgtgccgttgagcctgaagatatttctgacggcttttgcggtagttgatgatatcggaggtatccttgtaattgctcttttttatagttcgcatgtgtcgtatgggtatattctgatagccgcattgctttacgttttactttattttatagggaagcgtgggactaccaataagattttctttttagtgatcggtgtcgttatatggtatttatttttgcaatccggtattcatagtaccatttcgggagttattctggcgtttgttattccggcgaaaccccgtctatatgttggaaaatatatcgagcatattcgtcatacaattgcaggtttcccggtggtggaatcgggaagtatcgtattgactaatgagcagattgccaaactgaaagaggtcgaatctgcttccgaccgtgttatcagtcctctgcagtctttggaggataatttgcatggagctgtcaattatctgattcttccgttgtttgcctttgtcaatgcaggcgttgtctttagtggcggcggtgagttggtgggaagtgtagggatggcagtggcagcagggttgctgtttggtaaatttgcgggaatttatttctttacctggttggctataaagataaaacttactccaatgccgccgggcatgacttggaagaatctttccggtatagctctgttgggagggatcggttttacggtgtcgcttttcattgccaatctttcttttggtgcaaactaccctgttctgttgaatcaggctaagttcggagtgctatcggggactattctttccggattattaggatacattgtactcaggatagtattacctgtccgaaagcggaaataataactagagatcagtcgttcaggcatatcggatattcatcaggcgatatgccttttttattgtatatataatataaggtgaaaatgatatctactaataatattagttaaacaactgctttatttagtagattaactaatagtgttagttgtttgtttgaaaaatagtattatatttgtgccattggaagaacaataaatatgtagactatgaaacagatgaaacgattgaccgtcaaagaggaagaaattatgcgtatattttgggaacatggacctatgtttgttcgtgaacttctatcattctatgatgaaccaaaaccgcattataacacagtttctacccttgttcgagggctggaggagaaaggttttgtggggtataaagcctacggaaatacttatcaatattatgctcttgtttcggaaaaggagtataagagttcggcactcaaagaagtggtttcccagtattataataattcctatatcaatgtagtgtcttcttttattgaagaagaagggatgtctgttgatgaactaaaatcgctgatagagtatatagagcaaagtaaaaagaagaagtaatctctctctggtctatcggacagatacgatttttattctatggacaaacaacttttaatctgaaaacacaatgggagcttttttattctatctgctgaaatccggatgttgcttagtggtcttttatattttctttaagctgctgatgagccggagtacttttttccgttttaaccgcatcactttgttggttgggttgttaggatgtactttgcttccacttattgagctgacaactaccgaggagacttttttgcatactccgttgtatgccattcacgagatattgcaaagtacggagtctgtcattctaaatccggaacagatggaagatcctattcttatatctgaaaagaatccggaaataaactctttgaattggattcctgtgactttagcttttatatatggagtgggggctttggtgacactgatctggttgtctttgtccacttgtcgtttgattcagttgattcgtacgtcagagaaaaaacagtttggaaactatgtattagtgattcctcagcagccaactgcttcatttagctggggtaaatatattgttatttcagcagctgactactctcaacagtccgaagaaatactcctccacgaaacgatgcatttacgaaatcatcatactttggacttattgtttatgcagatattcctgcttgtttattggtttaatcctgtcgtttggctactaaaacgggagttgcaggaagtacatgaatttgaagccgataatggcgtaattaatacaggcatcgatgcaactaaatatcaattattactggtgaaaaaagctgttggtacaaggctctactctatggctaatggctttaatcactctaaacttaaaaaacgtatcactatgatgttaaaagaaagaaccaatcgttgggcacgattaaagctgttgcttgccgtgcctgtgatggctggagcgctttatgtgtttgcacagccggaagtgaaagaagttccgcgacagattcagtctgaacttcagcagaaagaagcggatgattattcatctttgatgttttttttcaaagaagggggagagagatacagcaagctggttaatggagcgtatccaccctctaagattaaagcaagacaggttcactccctttttgttaataaacaaaatagggtgatgttcgataatgatgtatgttcagtggatgagttgaagtctactattgtgaagaatttgatgaaatcctgggaagaaagtaagaggaaagaataccaagttatttcttttcaggttgatcgcggaagtgaaattgctgcactcactactatactcaaagaagtaaaaggagcatttgagcaaattcgtgctgatttgtctattacattgacagataaaagtgaagaagcgttggaccgattgtttcccgttctactgtcggaaggtgctgcgagaaattatggattgaaagagctgtcaatggaggagaaaatcagtgggattgtggtaacaattcacacttcggaagggaaggaagtaatgaaagattttactttaacggaattgaaacagaaagtcactgctgcacgtgcaaagcaagctgatccggaaagtttggttattggcctcaagatagagaaagggtgtaagatgggatacgtgacggataccaagcaggtgctgagggaatgtagtgcattgaagattaattattcaactgataactaattagtttataaatagtgtcactatatagccagcatagtgacactatccaatcagcatagtgacactatcccaaccggatagcgacaccatcttaaaaggtctataatttttgttttattcatcatccccgtcatccgctatcggcagaattctctgactttcctcatggggcaattgttctacttggcgtagtttccgttcaatagcgcgggttctttttcccatcacttcttccagttggtcaccggcactttgcaggttcttctgtaccttttcgagtaggcctccgaatttgctgaattcagttttaactgctcccaaaactgtccacacttctccggtacgcttttgaatagccagcgtgcggaaccccatctgaagactgttcaatatagcaccaagggtagttggtcccgtcactacaattttatattctttttgtagcgtctctaccaagcttgttcttcggatcacctctgcatagatgctttcaaaaggcaggaacatgatggcaaagtctgtggtgaaaggcgggtctacatatttatcgtgaatatctttcgccattttcttgatggttgtttccagctgcttgccggatgattccatcaatgcagtatctcctgcctcgaaagcgtcgtagtattgctcatatacatctttcgggaattttgcatcgataggcaggtatacagtgctgttcgcatcatccttacccggtaacttaatggcaaattccacaaattcagttccgcttttcttggttttcacattggcgtcatattgttccggactcatcatctgttccagcaatgctcctaactgaacttcaccgaatgtaccgcgcatttttacgttactcaatacttttttcagtccaccgacgtcttgtgcgagagatttcatttctcccagtcccttctgtacattttccagttgtgagcggacgatttcaaaggactgtccaatgcgttcattcaatgtcttctgcaatttttcttccaccatcagtcgcatatcatccagccgcttttcagtcgattttatcaagacctcttgctggcgtgccattgtgtcgaacttttggcgttgcagttccccgtttgtcatcatgttcttatgcagtacgtcttgcaattgttgcatattctgattcagcgtttgggtcatttccatgcgaagttcccggatactgcggtttagttcttcgcggttctcttgcatttgctggcgcaaggctgcctgtaattgttccgcttgcgcatgattatttccttttgccagtgatagtacaatcgagattactgctaatgcggcaataacaataagtagaatcagttccatcaataagtcagaatttcgtttccggtttcagtaatcagaatcatattctcccattgggcagaaggcagtccgtcatccgtgcataccgtccatccgtcagcttcgtcaacaaatacttcataagtacccatatttatcatcggttcaatggtgaaggtcatgcccggaacgatcatcattcctgttccccggcgtccgaaatgttccacatccggtgcttcatgaaactgcattcctacaccatgcccgcaaagatcgcgtaccacgttgaatccgttcttttctgcgtgttcctgaatagcggcgcctacatctcctaattgtttccaaggctgtgcggcggctatacctatttccatacactctttagtcacttgaaccagtttgcgcatttcgggacttacgtcaccgatcataaacatacgggatgcgtcggagaaatatcctttgtaaatggtagaaacatctacattgatgatatctccgctttgcagtatttctgttttgctgggaataccgtggcataccacatcattgatactggtgcagacgcttttaggaaatccttcgtagttgagaggagcagggatggcaccgtgctttgtggtgaagtcatataccatgacatcgatttcttcagtcgacattccttcacggatattctccgaaatataatccaacagggcagtattgattttggcactctcacggattccttccagttgttcgggagtacgcagtactttgcgcggtgggagtttgtaaccttgttttctgtatttctgtattttcgcttctacttcagccggataattggagggagtaaaccggaatcccttgataaagttcttcattattataggatgttttttaatcgtactacaaaggtacgagaataaatggaaaatgaaatcgtttatcatgtgattccttttttaccattcataagaaatacagatctgaggcacccattcccatcttttttgtatggtgttgtattgatattgtacgccggttttcaatttccagcctttacctacttttaaaacaatgtcgctgcctagtgtggttggtattgcttcagaggaaagtccacgatatcttcgggtgtccagattttgtttaccatatatgctaagaaaccattttttagagagcttataatccatttgagtttggatatgaaagtggtttgaactttcactaaagttacttttactatgcagagtgatatttttgtttattttgagccgtgaataagtgggtaagaaagtagaattggtctgtcgaaagatgttatgagtatgaaaaggtaatttcggagatatgattgttgatttaagaatcggtaatgttggatcaaagtcaacaaagggttttgtatgatataacatgttttgttctgtcttctttacgaataccttattgattctgatttcttgctcagaatttaatgtttgctgtagcctcaatgaatcttgtttgctccactcttgtcctgctacggataaggggagtaataatagacaaagagtacctaactgatatttataagcgtccatatagtgtgctagtatagtttattctatggacggtgaaaaagtgaaaatgctgctttatgtaatgaataaataatagctattttacataatatgagaatacttttctttttttgtataggtgtattaagcacatttatcgtgtccagtcgcacctatggaaacaaaacctatatagctgtttttttatgtattgagtgataagttctagtttcttgattggttcatctttcataaatcttgaatgatattgagagaaaaaatgaggtggaaaaatatagatgttataattacaaccactttttttctgagcattgcaggactcatagttcttattatcattctttaatgttttgtatttaagataatctttttgctttaaataccggttctatcttctgaatctccgattcaaatccgaaccaatagccatgtcctgcttcgtcaataggaagaaaacataaccggaggttctcacgatatgaaccatatataatttcccaattatcgggaggaacttggcgttttgtctttactttttcagcggggattttttttaacgacataccggcttctatccatgcaatactgacttgtgtcacgtaatcgggataatgattcttgcagaaattatagaggataagtccccttttttctagactcaaaggagtgtcgatgacatctgtctgtattagatggtcaagtaactcatgcaggaaatgcggattatccaaaatgagggtacgagtcagacttcgccatgtaggtgtattatagaatccgtctaaaagacgggacagatagtgggcggtttgcaattcttctacggaaatttctttagtctgcaaaacttcgtagggagggagaggagagtattggatgcctaactcttccgcccttcttcgcatttccgtgccgggaagtaattttaatgattccagttgtatttcccctgcaccatattcggcaagtgtacgaacgtcttcaaatatttcggataggtgatagagaggaagaccggctattaagtcagcatgtgtctccatgttcttaagggaacaaagatatttcagaccttgaagggcatcagataattttccgatacgtcggcttttctctaatacgggttcacgaaggctttgaatacctgcttcgaggtgtagcaaaccattaggtaaaatagcgagttcttctttcaattcttcggagagaagtgccgggtgaatttccaaatggaaacagatgtccggggcatattcacggaagaggtgaagaagttctttggctcgcttattattatagttgaaagtgcggtcgagtacacgcacatttttgatgccatgctgatggataacattcagtcgttcgcggattgcctccaatgaaatggtgcgaaccggtttctcacctccgctgacgcagaaagcgcatgtgttgaagcatcctcgggtagtttccagttgtacgaaaggcttgctccaattaaaaaaacgacttttctccggtgagacgagctgagagaagttcatgacacgggcaataccgttgtcttgatattggtctgattcgtccagataacataatccggatatctgattccactcatttacagggtgattccatacttttaaccaaattgggaatacttcttctccttctccccgaaacactccgttgacaaatttgttctttcttaagaaggcttcgttatttcctaaaaactccggaccgccgagtacgatgcagcaatgaggtagcaaagctttagcacgtgaaacgatatgcaacagttgctcgtgattaaatagccagttggtagcagcaataatatctggttgatggtgatagatttggttgactaccattccggtattttcgttgatggttgccgatactgtacaccactcaatggtagtgtcatctgctatttgagcatgtaatgcaggcaatgccagcgatgagtgcgcataggagctatttaaatcaagccaaagaagtttcatgtgtaaattttactattagtgggacaaaggtacaaaaaacttgcatcttaaggcatatagtaaaataaaaacgctaattttgcaataataaacgcaataaactagaaaattatgaagaatttgaaaaaatacgtaggtgttctcatgttgctgactttattggtcggctttacttcgtgcgaagatgatgaaactatatttgatcacatagtagggcgtacatgggttggtgatttaggattttgggtagataatagtccggtggaaagtggaataacctttaagagtaatggttttggtgtagatgaacaatggtattatgattgggatagagtagctgctgttttagatgtccgctggtggattgaagatggagatttattcttggattatggtaatggctatcctttattaatattagcagatgtttatgttgaaggccgatatcttacagggcgtttgtattcaaataatatagatcaaggaaccgttactttagaaatgagtaattagtgaagatctaaaaaagaattgtggaattggaaaaaatatcgattttttataaaagttccccttattgaaggctaatctatgtacagagttgtcagcaaataaggggaatttttattattttatttcttcaggaacaacttcttaaactctcctggataaggtgtctcaaactccattaaatctcccgtcaccggatgatagaaacaaagtttgaaggcatggagtgccagtcttccgatcgggttaagcgattcttcgcctccatatcttccgtcccctataatgggatgtcctaaatcctgcatatgtacacgaatctgattcttacgtcctgtttccagatcaagttctaacagtgaataaccgttagcacgtttgattgtcttgtagtgtgtgatggattttgaaccaccatcatcgtaatcgctggagcttacataaagagttttatccgtcagccaggaaaccacagtgtcataatccttctccattgttccctcaacaacagctacataacggcggtcagtcactatttcatgccagttgtcacgtaatgtccgttgtgttttctcgtcttttgcgaacatcattaatcctgatgtatccctgtccaggcgatgtacgataaacacacggtgctgtctgcccgagcgctgtacatattcattcagaatcgtataagcggtgcgctctttttgtcgctcggtattgacagataagagtccttgcattttttccactacaatgatataagcgtcctcatatacaattttcagcagtctgttatgaaattccttctttcctttttccttgctgatttgtactttcattccgggttgcagcgggaagttgaactgagtggtgattacgttatctaccaataccacccgtttgctcagtaatgacttcagtttcgtacggcttgcgtccggcattttagcagccagaaactccattagttccatgggctctttgactgcatagttcgtatattgggcacgtgctttttctgcaggagttcttctcggtcttttttccatttcttttttcttttgcgaacaattcaactaacgtattatcgaagctccagcaacactacattttccacatgatgcgtatgcgggaacatatctacaggttgcacagctttcactttatatttgccgtcaagcagttgtaagtcgcgtgcctgcgtagccgggttgcagcttacatacacaatccgcttcggttcggcaaacagaataacatcaaccacatcctgatgcatacctgcacgtggggggtcggtgataatcacatccggacgtccatgctgattgataaattcctgagtcagcatatctttcatatctccggcatagaacaaggcattcttaatctcattaatctcggcatttacctttgcgtcttcgatagcttccggtacatactcgataccaatcacctgacgagcctggcgggatacaaaattggcaatggttcctgttccggtatataagtcgtataccagttcctttccggtcagcccggcaaattcgcgggctatcttatataaattgtatgcctgttcggagttggtctgatagaatgatttcggaccgactttgaaacgcagtccttccatttcttcaaacatatggtcttttcccttgaatacatgtacatccagatcattgatcgtatcgttgcacttattattaataatgtataggagagaagtaatttcggggaatgaatcggcaatgaactgcagcagttgcttgaatagttccatttcatggtcttccgtaatcttacagatgacaatgaccattagttctccggttgatgaagtacggataatcatattccgtagcatcccttcctgagtgcgcagattgatgaaggagtaatcatgctcgtatgcataatcgcgtacagcattacgaatacgattggagatgtcgtcctgtaaccagcatttttcaatagccagcactttgtcgaaagctccgggaatatggaaacctacagcattcatctgatcatacttcacatcctgccgaacttcatcgtttgtgagccagcgtttgttcgaaaaagtgaactccagtttattccggtagaactctgttttggcagaacccagaatcggtgagatttccggaagttcaatctttccgatgcgtctcagattgtcttctacttgtttctgcttatacctgatttgttccgaataggggagtacctgccatttacaaccgccgcatacgccgtagtgttggcagaaaggaacggcacgtacgggcgacagctcgtggaatttcacagcttcggcttcggcgtatttgttctttttgcgcttgatctgcaggtctacaacatcacctggcactacataaggaacaaaaatcaccaggtcgtttacttttgcgatggcttttccttcggcagccacatccgttattgttaccttctccagcaggggaagttcttttctctttcttgccacttttacaccaatctaataattatgatgcaaaagtaggtattttttttggaaaactttcgtgtctatgaaaatattccagattgtaatgtcgaaattgcattttaatagaaagttttttctcaaaaagttttctggtttgcgaaatatacttagatttgcgaacagaaaaaaatcataatgtaactttaaacacaatattatggataaaaaaagagtttatacctttggaaatggtcaggcagaaggaaaggccgacatgaagaatttgttaggtggtaaaggtgccaatcttgccgagatgaatttaattggaattcccgttcctcccggattcacaataactacagaagtttgcacggagtataatacgttgggacgtgataaagtggttgagttgctgaaagatgaagtagtaaaggccattgcccgtgtagaagaattgatgaaatctaaattcggtgatatcgaaaatccattgttggtttctgtacgttcaggtgcccgtgcgtctatgccgggtatgatggatactattctgaatttgggtctgaatgacgaggtggtggaaggtatcatccgcaagactggtaatgcccgttttgcatgggactcttatcgtcgttttgtacagatgtacggtgacgttgttctgggcatgaagccgacgaacaaggaagatatcgatccgttcgaagcaatcattgaagaagtaaaagaatcaaaaggagtaaagcttgataacgaactggaggtagcagacctgcaagaacttgtgaagaagttcaaggccgctgtgaaagaacagaccggaaaagattttccaacttgtgcttacgaacaactttggggagctatctgtgccgtatttgattcatggatgaacgaacgtgctatcctttatcgtaagatggaaggtatacccgatgaatggggaacagctgtaaacgtacaggctatggtattcggtaatatgggtgacacttctgcaacgggtgtttgtttctctcgtgatgccggtacaggtgaagaccttttcaacggtgaatacctgatcaacgcacaaggtgaagatgtggtagccggtatccgtactccgcaacagattacgaaggttggttctcagcgctgggctgtactggcaggtgtgactgaagatattcgtgctgcgaaattcccttcaatggaagaagctatgccggaaatctataaggaactggatgcattgcagactaaattggagaaccactataaagatatgcaagacatggaattcaccgtgcaggaaggtaagttatggttcctgcagactcgtaacggtaaacgtaccggtgcggctatggtgaaaatcgcaatggacttgctccgtcagggcatgattgatgaaaagactgctttgatgcgtgtagaacctaacaaactggatgaacttcttcacccggtattcgataaatctgctttgaaacaggcgaaagtgctgactcgcggtcttccggcttctccgggtgctgcaaccggtcagattgtattcttcgctgatgatgccgccgaatggcatgctgccggaaagaaagtggtaatggtacgtatcgagacttctccggaagacttggccggtatggcagttgccgaaggtatcctgacagctcgtggtggtatgacttctcatgctgctgtggtagctcgtggtatgggtaaatgttgtgtatccggtgcaggagcattgaatatcgactataagactcgtacagtagaaattgacggcattgttttgaaagaaggcgattatatttctttgaacggtagtacaggcgaagtatataatggtaaggtagaaactcaagctgccgaactttccggagactttgccgatttgatgaaactctcggataaatatacccgtctgcaagtacgtaccaatgcggatactccgcacgatgcggaagtagcacgtaactttggtgcagtaggtatcggtctttgccgtacggaacatatgttcttcgaaggtgaaaagatcaaggcaatgcgcgaaatgattctggcagaaaatgcagaaggacgtcgtaaagcactcgcaaagattcttccgtatcagcaagccgactttaagggcatctttaaagcaatggccggttgtccggtgactgttcgtctgctcgatcctcctttgcatgagtttgttcctcatgatacgaagggacagcaggaaatggctgatacgatgggtgtaagcctgcaatatatccagcaacgtgtagaatcgctgtgtgaacacaatccgatgttgggtcaccgcggttgccgtctgggaaatacatatcctgaaatcactcagatgcagacacgcgctatcttgggtgctgctcttgaactgaagaaagaaggagtagagacacatcctgaaatcatggttccgttgaccggtattttatatgaattcaaggaacaagagaaggtgattcgtgaagaggctgccaagttgtttgaagaagtgggcgacagcattgatttcaaagtaggtactatgattgaaattcctcgtgcagctctgactgctgaccgtattgcttcatctgctgaattcttctcattcggtacgaatgacttgactcagatgaccttcggatattctcgtgacgatatcgcttccttccttccggtctatctggaaaagaagattctgaaagtagacccgttccaggtgctcgatcagaatggtgtagggcagttggtacgtatggctacagaaaagggtcgtgctatccgtctggatttaaaatgcggtatctgtggcgaacatggtggtgaaccgtcttcagtgaagttctgccatagagtaggtttgaattacgttagttgctctccgttccgggtgcctatcgcaagattagcagcggctcaggcagcaattgaaggatagaaagataaactggttagaaagttaactttctgataattgggctgtaatcgtctcgtgagagaatgattacagcctttttttgttggatgatgttatttttattgtatttgttcagccttgataatcagctgttaataaggatttgtttggtgattattataaaaaactaactaaatatttgtttaagatgaagaagtagtttaattttgcccccgaaaacaaaacatgtttttattttataacttaaaaagaaagaagatgaaaaagggtttattattggtagttgtaatgttagcaactatcgctgtaaaagcacaagacatttacgtaggcgggtctttgaacgtatggcgtaacagcacaggcaacactacctcttttaaagttgctccggaaatcggctacaattttaatgaaacatgggcattgggtgctgaactgaactattcacacgaatatgtgaaacaagtgactgcaaatacagttactgttgctccgtacatccgttggtcttactatcagaatgatgctgtacgtctgttcctggacggaactgctgctattggtttcgtgaaaatcaaagatggtgataccactaaagcaggtcagatcggtttgagaccgggtatcgctgttaaattgaacgatcatttctcttttatcgctaagtatggtttcttgggatatcgtaagaatgtgaacacttccggagattctttcggtctgatgttgactagcgaagatttgtctattggtttccactacaatttctaatcgagtagtagataataaaaaaataggaaaggggattctctaaaatagggaattccctttctttatgtattatctctatattttacacgtttattcacagaaagattgctttcttgatattttggcatatatttgtgacgtaaaaacaaacgggatgaaacaatccttaatacttaattaaaactagaaaattatgaaaaagagtgttttgtttattttatttgcgctggtatcggttgcaggcttctcacagattacaggttggaatgctaaagtaggtatgaacgttagtaattggacaactgatggggtagatgcaaaagttggttttagagttggagtaggaacggaatatgcttttaatgatatgtggtcattgcagccttcattattcttttctaccaaaggtggaaaggtggatagtggtgagatgctgggagcaagtgccaaagtcacaatgaatcagatgtatctggagttacctgttatggctgctgcccgttttaatgtagccaacaatacgaatatcgttataactgccggtccttatttaggttacggtgtaggaggtaaaaccaaagcgacaatcaaatacgagggagaaaaagctacggcaaagtttaacacttttggtaagattgataaagttactattgaagcaggaggacagagccatgacttttctattggagatattattgatccggatgaatatgatttatctgaaatgaaaggcttgcatcgttttgactttggattaggagtcggtgttgctttggaatatcaaaagtttattgtaggacttgacggacagttcggattaacaaaactagatactgatgccggaaagaacttgaatttcgcaatcagtgtaggatacaaattctggtaaaagtatataaacacaagggggcgtattaaaactccccttataaattaaaaatcaccctcgctacagttcaatctgtagcgagggtgatttttaatttataagggctctgatatacccttttgcagatgaaccatcgggtatataagtactgaaagtacacctatattcctcttagtccgctaatttctttaacttcttgaaatgctcgatcacagccagataattctgatccagacaggcatcaaatcgattccaaagatctcccaatacaacagcccctccaaatccgaaatcttttatttctagtagattatcttcattaatacctccaagtgccattacttttgagtcaatgatcttagctttctgtgcctcacgaagttcttctgccgtataagtagaatagtaattaaccttcgaaatactatcgtaaatgggactcatgaaaacgtaatcatagaaatgctttctgttcttcacctcttctacggaatggcaggaacaactgacgtgtccggcataatcatgcggttcgctcgggttgcgtgcattcaggtggatacccatcagattgaactcttctttcagataaaaatgttcgtgtgtcacaatgcggcgatgatatttttccggaatcagcgtcagtaatcgttcggaatacatggccggtgtctcaggttttctgagatgtagaatatccagtccctcctcgaaaagagcggtaataatcttatcttcttcaacgaagaacgtgggcgtggtaactacaattagtttcatttcctttgtaaagttgtaaagtttagcaaagttactaattaactatttcagaaaccaacgtttatagtgaaaatttgttagattgcaatgtacgcaagtcaatagtccatagtttacctgataatacttcgccaaaactgcagataattttcagcacttccgttgcttcgatgcttcctgttaccgcaggagtaatgcccattacacctttggagggcggaggcattcgcctcatttcttcttcgtccggatataagtcccgataactttttttctcttctccgtaatggaaaacggatacctgaccttcaaagccgcagattgctccatagacatacactttccccatttccgcgcagatgtcgttgataagatagcgggtagagaagttgtcgcagccatctactactatatcatactgactgataatttcctgtgcgttttcctctgttaaacgggttggataagtccggatagttatctcgctgttaagtgcggaaagtcgttcggcggcacatattgccttgggtttacctaattctttctctgaatagagcacttgccgttgcagattactgatgctgactacatcgtcgtctaccagtccaatgcagcctactcctgctccggtcagatagagggctatgggagagcctagccctcccacgcctacaataagaacctttgcttgtttcagtttctgctgaccgtcttctccgatttcgggaaggatcatttgcctgtcgtaccgcatcgttttatcttttaaagtcaaaagactggtcccaatccttccagaccggttcacgtcctaatttcctcaggtcacgttccacttctaccgctttccgttcgtcactcacgtggaactgctccagcgtttgcgggtagctgtaatatccgcccggttctgtcttgctttcggcactcatggttgtcacgcccagtgttgccatgtgatttcgtatctcggcgctttcacgggtagaataggagatgtctacatcatgatcgaagattcgcatggcgaaagtaagctgtgcaagttcccggtcgttcatgataacgttgggttggaagccatcgttttcggatggacgcatacgggggaaattgacgctgtatttggtcttccagtagtgcttctgcaggtagcggaggtggtaagccatcattgtcacatccgtccgccattcctccagaccgatcaggacacccatgccgatcttatggacacccgcctgtcccatacggtcgaaaccatcgacacgccattcgaatttggacttcatgcctcgcgggtgatactttttatagttcgccttattataagtttcctgaaagcagatgactccgttcagcccgtgatgggtgagttctttgtattcttccgctttgaggggcatcacttcaatctgaaggttgctgaaataaggttttgccagatcgagagcatgggcgatgtaaggtacacctgctgctgccggattttcacctgtcacgagtaaaagattctcaaaaggagccagccgtttgattgctttgtattcgttgatgatttcctcctccgtcagaatcgttcttttcatcggattactgatatggaaaccgcaatagacgcaggagttggtgcatgaattggtgatatagagcggcacaaacatagagattgttttgccgaaccgctccatcgtatatttctggctgaggcgggccatcacttccagatagggagtggcggcaggtgagatcaatgccataaaatcgttgacatccagatgctcttttttgcctaatgcacggcgcacatcggcatctgtcttggaatagatggcttttgtcgtctcttcccaggatattttttctaattcgtctgagaacattttaattaattgaaagttgaaaattaaaaagaaatgagattgtgacttggtttggggatattcacaatttattatttatcactcttggcatttttcttcagatcacgggataatctcatggcgcagaaattaggtccgcacatcgtgcagtattctccgtcaatgtgatgtcctgcgcggaaatacccctgtgcccgttccggatcgagagacaagtcgaactgatctttccagcggaactcgtaacgggctttgctcaaggcattgtcgcgtacctgtgctcccggatgtcctttggcaaggtcggcagcatgagcggcaatcttataagtgataacgcccacacgtacgtcttctttatccggcagggcaaggtgctctttcggagtgacataacaaagcatcgccgtacctaaccagccgatttgagcagctccgatggcagaggtaatgtgatcgtagccaggagcgatatccgtcactaaagggccgagtgtataaaatggcgcatcatggcatttctcgatctgacgttccatgttctccttgattttgtgcatcggtacgtgtcccggaccttcgatgaatgcctgcacgttcttttcccatgcacgaagtaccagttctcccatcgtgtccagttctgcaaactgtgcttcgtcgttggcatcatggatagagcccggacgcagtccgtctcccaatgatacggcaacgtcgtattgagccagaatatcacagatatcgtcaaagtgttcatacagaaaactttcctgatcgtgcaccagacaccatttgctcatgatgcttcctccacggctgacaatgccgcacagacgtttatcggcaagatgaacattatgacggcggatacctgcatgaatcgtaaaataatctactccctgttcgcattgttcgatcagtgtgtcccgatagatttcccagttaaggtcttccactacaccattcactttctcaagtgcctgatagataggtacagtgcctaccggtacagggcagttgcggatgatccattcacgtgtctcatgaatattttctcctgttgaaaggtccatcagcgtatcacctccccatttgcagctccataaagccttttccacttcctcgtcaatgctggaagtggtggcggagtttccgatattcgtattgattttcactaggaagttacggccgataatcatcggttcggcttccggatgattgatgttggcaggcagcactgcacgtccttctgctatttctttacggacaaattcgggagtaatgtgagtctcgattcccagttcctcacagttcatattttcgcggatcgccacatattccatttccggagtgatgattcctcgtttggcgtatgctatctgagtgatggcttctccctttttggcacgatagggaagggcaatgtgttcaaagcggagatgatccagacttttgtcatcacgtctcatttgtccgtattccgaagtgatttcggggagttgctctacgtcaccgcgtcccacaatccattcttcacgtaagcggggaagtcctttcttgagatcaatgctcattgacgggtcactgaacggaccgctggtgtcatatacgtatacttccggattcggagtagctatcttttcttctccttcgaagctgacactgggcacttgttcaactttccgcatggctacacggatgttcggatagagtttacccggcagatacactttctgagaacgggaaaattttattttttgttccatagaattttattatcgtattattaagaatagtgaaacaaacactactccctacttattacctattacttatcacctattacttattccaaaaatgcagttaaaggtgaacttgcttctgctataaagttatcagcctgcagacccagtcctgcttcgtatgcccgtcttccggcttcggtggcggctttgaaggccaacgccatttctaccggattgcctgctacggcgatggcggtatttaccagtacggcagaagctcccagttccattgcttcggcagcgtggctcggtgcaccgattccggcatctacgacaacggggataccggcctgttcgataataatctgcaggaattctttggtttgcagtcctttgttagttccgatgggagcacccagcggcattacggtagcggcaccggcttcttccagtcgtttgcagagcacagggtcggcctggcaatagggtaatacgatgaagcccagtttgacaagctgttctgtagccttcagggtttcgatagagtcggggagcagatagcgcggatccggatggatttccagtttcagccagttggtaccaaaagcttcacgtgccatctgtgcggcgaaaacagcttcttccgcatcgcgtactcccgatgtgttgggtagcaactggatattcggatgaataatatgtttcagcatgtcgtcttctttgtcatccatgtcgatgcgcttcattgctacggttaccatttcagtgcccgatgtcagaatggcttgttccattacttcattggaattgaattttcctgtacccagaaaaaggcgggagtcgaactcacggcctgcaattactaacttttccacttttcaattattttatttgattatacatttcatgttcaaaatctttcgtgtttccgctgccggatcctccgcccgaagaatcgttccggaaagtgctattccgttcactccggtttcgagtatggcgggtatatcctcacaggtgattcctccgatggctactaccggcagttcgatattcgcttctttcatctgagataaaatagcggcataaccttccagtcccagaacaggactcaggtttttctttgtagtggtaaaccggaaaggaccgatgccgaggtaatccgctccggcacggtagtgctgtacgacatcttcgaatgtatttgccgtacctccgataataaatgcttctccaagtaattgtcgtgcctgatctatcggcatgtcttttttgcccagatgcactccgtccacttccagctttttggcaagttcgacgtgatcatccagaagtaagatcgcttctttttctttgcagagaggctttagttggagggcaacagcttccacctcttcatacggagcttccttcatgcgtagctgaatccatttacatcctccttcaagtgccatgagtgccgattcgaaataagtataccgatcggtctggtgggtgataaattgtagactgaccatacttttaccctccacaagccgctttgatgaccacgaggttatcattctcctgtaacgcgaatttctcccattcggaacgtggaatcattttgttgtttacggcaatagcgatgccttgtgccggaagttccagttgggcagccagttgtgtaagggtagaagcaggagtcatttccacctctttgttgttaacttgtactttcattgtcctatcagtattaataagttgaaagtaaatacaaagagcgtgcttatatagaaaggcgataagaaagaaacacaatccctacgtcagtgctaactgcctcaggttcctagggtataatctcagcccctctttggggcacccctttgtctttacgggagcaaagtaagcgaaaaagaaacaaagattcatcaaattatccggttttttttcatttttcttccgattcccgttttttgataggatgagaaaagacaaaccgtgctccgttcttataattcttgtcaatccagatatcgcctcccatgcgttgtatggtcagtttgcagattgccagtcccaagcctgttccctgcacaaattcgttgagcttctcaaaacgctggaataccagttcctgcttgtcttcggggatgcccgagcctgtatcggtcacagagaacagcatacactggtcttcttcatctatttcataattcagcgtgatacttccgccgtcgggagtaaacttcaacgcattgttcagtaagttgatgataacctgctgcaaacgtagcggatcggtatagagcatataaggctctttcggcatctgaagcctgacatctatatctcttgtccggttctttctggtcagtgtgatcatgttctggcaatgatttaccagttcgcaccattcatacttgaacagcagtttgcctgattccagacgtgatacatccagtacatcactgatcagttgcaataacaattcggaattagtctggatgatatccgcatattccttctgctcgtccgttgtttccacggtatcgatcagcaggctggaaaagccgacaatggcgttcagcggtgtccgtatttcgtggctcatatttgatacgaaggcacttttcagttgattggcttcttcggcacgctctttggcatgacgtagtgcaatttccgataattccagtttctttttatcttcccttagttgggctgtagtcttctcaaggtgattctttaagatttttgtccggtaataataatacagtgagataaacagtccgcctatcagtacaaggaaggtaaacaggatgaattgcacttccgtccgatatgcctgaaagaaaggcacctgttggttgatgataagtgaattgaaaggtagtttcttgtcctgaaatccccattcatgcagtttgttggcatcaaatttgtatctgttgggcaacaaatgaatgtggccgacattgtttttccccttgtccagaaattgataagcctgttctcccatgcttctccctattccgtcgtattgggggatatatcctccgattgcccaataaccgatggcggtagcagtcaggctgaaaacaggcaactctggattcgctttggagaaagcatatacagagttgttcatatacgttatgccccgattgtcaattctccagatacccagtagtgcaaccgaatttttggggacatcgcgtagttgtttggcggcagcatcaagggtgtggatacggccgtcaatataggtcgtcgatatttccggatagcgtttcatattcttttttacccacgcttgttcggcaagtccgttgtaggtgttgtccgagatgaacactaaatgctccatatccggataaaagcttcgcatcatttctatgtccttatcgatatcatattcatatgtgttacagtatattatattgtatttgttcattctttccgttaagtcgatactctgaggttcataagtccgtatatcaatagagtcttccggaatacggatgccgttgcgcgatgccatagcgcaaaatacgggcagttgtctgtacttctcgtcttcgaggtgcaggaaactgctccacgcttcgccacccagcaggataaccagcttggcgttcggatgtttgtccagaatgttggtaagtctttttttccattttctggattgattgaggtcggtaacattcatgttttctacgatggtggaatacttgccacccagttggcggtacgtttctacgaacgtgttgatattatcgtaggtatatttagtatcggaattataggacgtcacgaaaagaatctcctcttccggttcttccggaatagccgcattgcctgtaaaggagaataaaagaaaggaaataacgtagacaatgcgccattttttattttttagctgaagtgtcataattgtctgttttgattttcggctattgcaaaaatacaaattatgcctttgaaatacaatagatagtttagttttttatgctagaaaaaaggccgctgtgaaattcacaacgaccttttcaatagtatagtttagcttaattttaatgagtccggttacattcgtttttctaccacatcccagtcgatgatgttccacagggcgtttacgtggtcggcgcggcggttctggtagtccaggtagtaggagtgttcccacacatcaaaacccagaagtggtttcagtccggcgcgtacagggttactgccgtttccttctttggtgatatgcagtttaccgttcttgtctactgacagccaggcccatcctgaaccgaacaatccgactgctgctgcattgaattctttcttgaagttttcaaagctgccgaaatcacgtttgatggcttctcccagtttgcctgccggttcctttttcgaaggtttcggagcgaattggaggaaatataaattgtgattcagcacttggccggcgttgttgaagatagctccatcgggagcggtggcaacgatttcttctaccgttttgccttcatattctgttccgggcacaaggctattcagattatttacatatgtttgcagatgttttccgtaatggaaatctatcgtttgctgactgattacaggttccagcgcattgtttgcgtaaggaagtttaggcatttcgtaagtcatggtcataattattaaagacattaatatagtattcatattgtcaaaactttaaatggttttgttatactataataacagccatagttcgcaaaaggttcacggtattttatttttatttataaatgtactgtatacgttccacttgctgcgggttgtcatagctggtgcggcatatccattgtcccgtattgtcatattcgtaataggagtcaccgtcgatccggtttccgtactcgtcgtacaggcaggtcaggcagccggacgtcttctggctgttgccgaagatacgttggtagacgatgcgggtgaggtatccgtatttatcatattcatacagttctttttgcgagagaatctggttgggcgaattgacaaagagcatattctgatgctgagattcggtcattctgcctttgtcatcatatttgttgactgtatatccctccatttccccgttcttgttgtactctttggtttccgtcagtaatccctgcttgttgtagctgctgacggtatatctgccgtccatgtattttagagaatcgctttcgatgctaccgtcgataccgatgcggcgtgcacggcggtaaaagtccgttttggttttcggattagttttcacttcgaagatgcagtggccttgcgggtcgtacagcctgctggtttgcacctcgttgatgggttgcccgttcttttcagtcacggataatgtggtggtaagctgccccttgtcattgtaggtgtagctggtcgtaatattgccggtgctgtcggtttcgcagcactttatcaatcgtccttgagtgtaatatttcacggtagtcggggtggaaacaatggcttgcaggataaatggagcacgcaaattttttgcctggtcacgaaattccttatacttgtgtgttttgaggaattcctgcaataaaccgagcgattcggagttgactattgccggtttcagaagctcgaagtctgccttttcactgagatattcaagatcgttcaggtgagtccgtgcaccggtggccagataaggtgtattcttataatcatcgatgatctgccggatggcggtggcatttccttcttttttcaggctgtcgatacgttggaaaaggaaatcatcatataaggtacggacctcggcaagataggggcgcggacctctgtcttgataatacttctgcatttcggggtcttcaaagaaggctttgaagtttgcaggagtcggggccgtcttcaccagttggtagagccgtacgttttcggaggcgttgacttgtgcgataaatttgccgttgggatactccttgacgtaagtctggtaaatgatgggagtgggggctttgagcattccttccagcagtgccacctcgcggatgttctgcagccgttgcagcatggcggagtcaaccggatattcggtggcgtgaatgctgtccagcagtgcccggctgaaaggtattttatcttttgaggcctccagcaggttgataatggactggtccgccttgtcccgtatctgagaaagcggaatcttttccccttcgcagatgccggggaagttactttgggcggctttctcgtagcagccgaagtagagggtggctgcctgttcgctctgttcgttccacaggtcgttgaggacgtccatcaatgataaatcttcggcatagtacgcctttgtttcgtcatccagtttttccctgttcttctgccatttgtcggcgtcattgtcgttcagataccttagcagcttttccatgcggctttgcttttgtgccattgcttgctgtggtatgcaggcgatgaggcacaaacataaaataaatgataaaaatatactctttttcattgctttgagtggttaggttaaatagttagtgatgaaaaatcataaaaatatcttcattgtcaaatgaatgttatacttttgtcgtattgaaacaaatttgaacgccaagggtttgttaaaaatcctcattgtttttataatgctgttatgaataccaactatatagaggaattaaatgagagtcagtgtgcagcagtgacttataacgacgggccttcgctggtgatagccggtgcaggttcgggaaagacacgtgtgttgacttataaaattgcctatctgctggaaaacggctatcaaccgtggaacatcctcgcactgacctttaccaataaggcggcgcgtgagatgaaagaacgtatagcccgtcaggtgggcatggagcgggcacgttatttgtggatgggtaccttccattccgtcttttcccgcattctccgtgccgaagcaaagtatatcggattcacttcccaatttaccatttatgattcggcggatagtaaaagtctgatccgttccatcatcaaggagatgggactggacgaaaagacatataagccggggatggtgcaggcccgcatttcaagtgccaaaaaccatttggtttctcctacgggatatgctgccaacaaagaagcgtatgaaggagatatggcagccaaagtgcccgctgtccgtgaaatatatacccgttactgggaaagatgccgtcaggcgggagctatggatttcgatgatctgctggtgtatacgtatattctgttccgcgactttccggaagtgctggcccgttatagggagcagttccgttatgtgctggtggacgagtatcaggatacgaattatgcccagcatagcatcgtacttcagctgacgaaagaaaatcagcgtgtttgtgtggtaggcgatgatgcgcagagtatctactcttttcgtggagcggatattgataatatcctttatttcacgaaggtttatcctaacacgaaagtctttaaactggagcagaattatcgttctacgcaaaccatcgtctgtgctgccaacagtctgatcgaaaagaatgaacgtcagattcggaaagaagtattctctgaaaaagaacgaggcgaaccgattggcgtgtttcaggcttacagcgatgtggaagaaggggatatcgtagccaataagatagctgaactgcgtcgggaacatagttacggctatgccgattttgccatattataccgtacgaatgcgcagagccgtgttttcgaggaggctcttcggaaacgaagtatgccctataagatctatggcggactttcattctaccagcgtaaggagattaaggacgtcattgcttacttccgcttggtagtgaacccgaatgatgaagaagcattcaagcgaatcattaattatcctgcccgtggcatcggtgatacgacagttggaaaaatcatctccgctgccactgaaaatggtgtcagcctttgggcggcgctttgcgaaccattgagctatgggctgaatatcaataaaggtacgcacaccaaactgcaaggtttccgtgaactgatagaaggctttatgaccgatcaggtggacaagagtgcgtatgagataggaacggatattatccgccggtccggcatcatcaatgatgtctgtcaggatacttcgccggagaatctgagtcgtaaggaaaacattgaggaattggtgaatggtatgaatgatttctgcgcgttgcggcaggaagaaggcaacccgaatatttctctgacagatttcctttcggagattgccttgcttactgatcaggactcggacaaagcggatgatggagaaaagataacgttgatgaccgttcattcggccaaggggctggagttcaaaaacgtattcgtagtggggctggaagaaaaccttttccctagtggtatggtgggcgattctccccgtgctctggaagaggagcgccgtttgttctacgtggccattacccgtgccgaagaacattgttatatttcttttgccaagacccgtttccgttatggaaagatggagtttggaagtcccagccgtttcttgcgggatatcgatgtgaattatttgcggttgccgcatgaggcgggagtcagtcggtcggtagacgaaggtgcggggcgtttccgcagggagatcgaaggtggatttacacgtgcggcatctcctacacgaacgccttatggtactaaattttccgatcgtgaacgtccgaagactcaggtgattgcacccagtgtgccgaagaatttgaagaaggtcagtgcggtgagtggaagcagtacacggtcggcttcagccggttcggcatctgtaacaggagtacaggcggggcagatgatagaacacgaacgtttcggtttgggcgaagtgatcagggtagaaggaacgggtgataatgcaaaagcaacgattcattttaaaaatgcaggggacaagcaactattgttgcgttttgcacgttttaaggtgatagagtaatcatagtaaaattagagatgatcatgaggaaacaactaactgtaattctgctttctgctctgatgttgagcggatgtgcatcgggacgtatgggaaatcccggagcaattgtaggtggtgctgcaattgggggaagtctgggaagttcgataggcggacttatcggagataataatcgtggctggaggggcggatatcgcggctctgccattggaaatattgttggcaccattgccggtgcagcgatagggaatgcgctgactgctccgaaaccggacccgatagaggaatatgcttacgttccggaagtcagacaagggcagtctcactctaagtttaaacctcggacgcagactcagcagcaactgactcagttgaaactgcgcaagattcgctttattgacgataaccgtaatcatgcgatagacgggggagaaagcagcaagatcatctttgaaatcatgaatgaaggacgaaatccggtttatgacgtggttcctattgtagagacggtcgggaaagtgaaacatatcggcatttctcctactgtaatgatagaagaaattcttccgggtgagggtatccgctatacggctacggtctatgccggaagtaagctgaaagatggtgaagtgactttccgcgtagcggtgtccgatgagaatggagtaatctgtgattctcaggagtttacgctgcctacgcagcgggcggaataggacaagaatagctcaaaatattcgatttgttatagtgacagtatgtgctcgggatagtgacactatccttggcacatactgtcactatgttaatgggatggtgacactatcccaatacaatagtccggtgcactcattacacaataaaatgaagtatcggtttcatctacacagaagcattctatatgagtatctgtcaaaattttacgtatcggttttccttcccagtcgaaaacccaaatctcgctgtttagagtttctttttgttcttcgtgcatccgattggtgtttgggttatacagtacataaacatagttattggaaacggcaatgcctcgtgctcccagttcggcatcaggattatcactttccgcatacacaccgtctgggcttgaattgaactgataatgatagggtgctaacaatagtcttttatggagcgttaatgtttccggcttatagtcccatagctcaagtacattactggtagcacatgccagacgtttccggtcggtgttgtaaccgaattgtgattgatgaaacatacctttagccgtattgggtatggtttcttctccactttgatagttcgggaagtcgccagatttggatataacattgccgtcattatctaaaataaggaatctgcaatcttcaaaaacgccggacgctataaagcgtgattcgctcatcggatagactctgtcaatgctcatgggcaggtgtatcaattctccttgtcgccggatggaaaagtctttcgcgttgaatgtatagttttgcgctgtgaagtgccatcgattgtgtatgaaagcagacgaatcagacagaaagaattcgacagggcttaaaaattcatcaggtccttgtccttgtggtagcatttgatttacaaagcgttgttcactaagactatagcagtataaaaggctgtctcctttaaaatcaccggcatataagatatctcctttcttttttatatccattggaatggagataaaggcttccttcaaagcggtagatttagcagttgtgctttcgctaaaggatactcttttctgtgattcactacaactgaacaatggcaatgccaaagtaaataatagaatgatgtttttagatttcattttgttttgctttattttgtactataactacaaagataacgtatgtgttttgaaaaacaaggatattgaagagaaatagggctaaaatatttatagtgagaacataataatataattggtattcggtaattaccatatattgtgttaactttgtgatttatttgatggtaattgtagttgcgtttttgctaaagggtatatttattgccataaatagtattgatccacataccaaagaacttgtcggtaaccgaatatactttattgatttctgtaataatgtctttttcaagcagttttttagttgcggactgtacagaacttgcggatgtcagactgtatcgtttgataaatttcgctgatgtgacgttttctgcttcacctactttggcaatggcataaagcaattccttttgcttttcgggaatattagataagatttcccgaaagattgtatcattatatgcaataaggttatctatagctgttttgataatttccagtgtacattctttccctttcggtgtatctgcaaaagcttcattgaatgttttttgaatataaaaggtatgtcctttgaatagccgatatactttttctatattttcgatttcaatatgccgttttcttttttggaaatggtctgcgataaatggtatatagatttccggtgcaatggctttcagttccaaaatatcggcactgtggtagaatggacgggatgaagatagaaacatttcctgcatcatgtgccgttcacttccggcaaagatgaagttgctgttttctattttctgtatgtgtgtgcgtagtaatgcttctatattcttctcgggatatttagcaatttgttgaaactcgtcgatggcaacaatacaaggtttgtctgctgctatcaggcattgaaatatttcttccagtgtatattcgggtcgatcaatatcccccagttccagattgaaagtaggtagattggtcagcgggtcaaatccgaatttaccattgattgatttaagtgtctggataaacaggctcgccattttcttactgcggggcaatagtgtttcataaatttctttgccaagcagataagtgaattctcttaagcttgatgtatggagtatgtcaatgaagaaagtataatattcttcttttatttcaggtttctcataacagaaacggattagtcccgttttacccattcttctgggtgagataatgacaaggttattgccattggttaatgatttaaccagcctctctgattctttcacgcgatcgcagaagtactcgggttctatttttccagttactataaatgggttaatttcttttgccatacctgtttcaattttccgtaaaggtagttatttgaatagaattatgcaaatcgaataatgttaataaagtatctagtcttgttttatgcttattggatattgaatattgttaacaaacttattttttttgctttaatatggtccgtttctttaaaaccaaaggcccgttggttttaaagaaacgggtcgttggttttaaaggaacgcccttttggttttaaaggaaaaatggcgatttgtatattattgataatcagtagcttgataaatcctgttttcagtcttattaaatagtaaaatatttatataagtatagcttaataaataagagttttgatgctacaaacatttatattatgaatatttgtctgactacaaagtggcttttcttctattaagttatatctttttttaaagagaaagtttagattgttgtgaaaaatgttatctttgtagtacaaaacaacataaagtaaagcaaaatgagacctaaaatcataattctgttatctgctatagcttgtattggaggaattgtattcttccttgcatgcaaatatacttatgaattcaaagtaacggagcttaaggagaaagcgaaagagacttttactgaagcactggataaagagttgaaaaatagaaatataaacggaggactgtcattttactttaattctgaatcggctatctctactgaaatgcctgattcagtttattgggaagatgcgtcaggaagacatttatatcggatggattccaagaaaaactctatgaatattactcataatagtaatttacgtgctttgcatacttttattttttatgaaaagccacttcagcctgactctttaaatcttatatgggatgaacaattaaataaagcagatatttatttagaatcagctttacgtatttctttgacgcatgaagacggtagtgtagaatctcaaaagacctatcagagtgaatggggcaattcttcaaatttagtttttactttttatataggttatgcctgtgagatagaagtaatgggttatttgcattacactctatgggggatgatatataaagaggtgctgctatatttattgctatatataattgttggatatggattttatacgtttttcataattctcagtcgcaggatcaattcattacgtagtaaagaaatagtcgagattatcaaggagactcccgtggaaatcttaaaagaggttcctgtggaaattatcaaagaagttcaggttgaaaaacaaataattaaagaagtacagagagtggatattattcccttacattcttacatattgggtgagagtctaatattctatgcagatcagaatatcatagaggtaaatgatgttaagtataatattcaggggcagtccagtttacttttagaactattttttcaagaaaaagataatggctatacattaaaggaagattttattatagaaaaattgtggcctgataattcaggtaatgatgagcgaatgcataaagcgattggacgtctgcgctcgtttcttagaaaaatagatccttcattgagtataataaataaaaatggtacttatcgactaattatatcagagaaatctcttgttaagagaaatagctaaaaatgtcgatgaaatggagctattttgaatttcaacttgatttcttcggataaaaatgatgcgaggtcaggattggtcagcggtattctttgctaattaagtgcttcattactacttttgctctcagaattaatctttaacgcaaaagtagtatgaaaaaaaatcttcttcttttattatgtatagtagctattttatctactaaatatttggcttctcatgaaaagagacaaagtgctttattgttatataacatagaagctttagctgctaacagtgagcatgcagatattggacattgttatggaacaggtactttagattgtcctgtatctcacgataaagttaaatatatcgctggaggatatagtcttgaaggtctttattagctttcttcttctctttatctgcatctcttgtggtacaaaaaatatggaatatgcagagaatgtatttccttattctgaatttccacaagagaaggagctaaaaggagaggtgatagagcttgatactgccttatttcgctgtccatttcggatacgagtagaaggagataaagctattgtaatggatttgcatggtatcgattattatgctcatttgttcaaatatcctggctttcaatatttatcttcttttgggaggcgcggtgattcaccaactgaaatgctatcaatggataatgttcgtttttacaatcataaagtatggacattagatgctaataaaagagaattaacacggttgggtttttcttcatccggtgattcactgctccgtgacgaagcggtgatattggatgaagatattttaagaccacttgactttgccatatataatgatactacctttataattcctgattattccggtgaaaaccgattatgttggcttaatgatgatggggaacttgtaaaaaagataggcgctatcccatcaattaataatcaaacgttacgaaaagctcgtccagcattggcacaggcatggcgtagtttcattgattataattctcataacggtgtattagcaatggtgactcaactaggtgaagtacttgaagtctataatttgaaggatagcacggaggttattcgtattggtgaaaacggggaacctaagtttaaaatatttgaaggatatggaataccttcaggaattatgggctttagcgatgtgcaagtaacagataatgccatttatgcagtgttccatgggactacatttaaagagattgtaaaacataatggtcatcttccagatggaggaaagtatatttatgtattcagtttgaaaggagaaccactatataagtatgtgcttgatcactatgtatatggtttttgggtggatgaagctacaaaaacaattatagcgacagatataaataatgatcagcctattgtgagatttcaatgtggttgaaaaaatagatagttaacgtgattaaaagaggagcaggaagatgggttagtcaattttgccggattggttcccatcatctgctactttattcctactaaaaagaaaggaggtgcgacaaagatagtgataataatggttatggcaaatacgtttttaccagatatagagaaaagtatgaaatgaaaaggtataaatattaaaaaatctacttaaatgaaaaagaaattaatgggcatagttactattattgcaattgctgctgttgcaggatataatgtatatgcttcgcggagtaacgtgaagttgtcggacttagctttagctaatgtagaagcattggctgattcttctgaaggttctcaaagtgattgtaacacatactgtatggtgagttattttgatacatgtatcattagatatacaaataacacttttactacttgttatgatagtagaataagaagatctaactaaccgattgtaaggctatataggtgcctactatttctatatagccttgctttaaaaaatgtaatcatgaatacccataattcttgtttaatactgcttttgacagtattattagtaacagtatcttgtgcagaaaaaagtggaagtaaatatcaagatgcaactttaattgaatatcaagattttgtatccagtcaaaaattgacagggataaattttttatcagataaagaagtattaaagccgatgcgtatatatgtttgtgacactattctgataacaatgaaccctatggagaagaagctgtttcatctttttagtttaaaatctaaaaaagaaataggaaaacgaatttcgcttggacaagggcctgacgaaatgattcgtccttctattataaaatttaatgagaatcagattctaatatttgatgttgccacttttacgttatttacgtatgataccgaggattttatttcaaatgaaaatacgattcctttagaaaggaagactatagagctacaagcatatggtgaaataggtttactctctgataatctaataggatcgacatataatcctaaaaatcaatttataaaatttgataataatggaaagaaggttggtgaatttggctattatccagtggtggcagacttatcatatacagacgatgagaaattggaggcttttaaatcttcttttgtgactaatatgaaagataggatagccgtttgttataaatggacagatttgattgatatctatgatcagaacggtcaattgaagaaacggattcatggacctgaacattcgtatgcacattttaaggaatttcgtaatggtaatgctattgcagctacctctgataaagataatatagatgcatatttctttccatataatgtaggagatgagttttttgtgttattcaatggaaagccttgggatccggatgataaagaagtagaattgccagatcgtatattcgtttttgattggaatggcattcctcagaaaatatatactttagatcaaggaataattaattttgctgttgataaagttcagaaaaagatatatggaattagcagttcaccagaatttcatgtggtggaattttcatataaataatagataaacgatgaaaaatatatgtcttatgttattgccattattcttgatgtcatgtttaaataaggataataacatcgtttctcttttgaaagaatgggaacagaaagaaattctgttccctaaagaaatgtattttacaacaatgttgagggatactacatattataatcttcagagtgagtataaaattttagcatatgttgattcgataggatgtactagttgtaaacttcaattgtcggcgtggagtatgttaattaatgaaattgattccttatatgcaggtcgggtcaagtttatatttgcattctctcctaatagaattaaagatatttatcatgctatattgactgctaattttacatatccagtatatgtggataaacaggatagcattgctaaacttaatagatttccattagaatcaaacctccacacatttttattggataaaaataatagagttattgctgttggtaatccagtttataatcctaaaataaaaaaactttatttcaatattatttctggtaagaaaccttttttaccgtgtaatgcagaacaaagaacaaatgctagtttggataaacgatttttagacatgggcagttttaattggaaacaggagcaaatatctgacattatattaagtaattcaggagaagaattattagcgatagaggatgtttctgtttcttgtggttgtattactgtggaatatctaaaagaaccgattcgaccaggtcagaaattaaatctgagaataaagtataaagcagagcatcctgagcattttgataaaacggtaattatatattgtaatgcagaaggttccccatttagactaaagataagtggaaatgcaaaataaagagggaatatggcaaagtgctttagggatttatcatatatatgtataatattatttattgttttgggatggcatattatggataacattgtatctgaaaaagaggtagatattacttctttagaagttgctttgcggtctgctggtgataatagaggggagctggaaaaagtcctttgttactataaaagaaaaaatacagatagcctgaaatataaagcagcctgttatttaattgaaaatatgccctttcatagatattcagttggagaacaattagaaaactataagtcatactatgcatggctgaaaaaaagcaagggaaaagaaccgcaacaagttgcagattcagttaagaaagtatatggtccaatgaaagaacccaataagatacgcgatattatggaaattgattctgcttatttgtgtcataatattgattgggcatttaaagtttggcaggaacagccttggggaaagagtatatcattcgatgtgttttgtgagtatttgttgccttatcgtattggcgatgaacccttggtatattggcgtgaaatgtactatgcaaaatataattcattgttagatacattgagaatgtcggattctttggatatagaagatccagtagtagctgctaattacttaataaataaattgcctgataagtggcattattatacttcaacaactccttattcctttgggcatatcggacctgaatatgtacaatacttgtcaggaacgtgtcgtgaagtgactgattttgctgtatatctatttcgggcattgggaattccttgtgctattgattttgttcctgtacgtagctatgttaatgctgggcatttttggttggtagcctgggataaaacaggtgaagcgtatatggctaattttcccgagaatctgggaatggtccgcaaaaattggtggtatcgttgggatgatagtccaaaggtgtatagatatacttttgatataaacaaagaattatatgagcaaatggcgaaatataatgaaaaggtatattcattttggagtctgccgaaatttatggatgttacttatgaatatgcttattcttttgaaaaggaattagtcattccattggaaaaactttataggaatcaatgtagtgggagaatagcttatttatgtgttactaatagagataactggataccggttgattggactgaatttgacgcacagcatctggcttttcgaaatgtacgaagaggtacgcttatgagggtggctacttacgagaatggtactttgaactttttgactgatcctttttatgtggataaacagaaaaaggagcagcattatttctctattgaaggaaatacacaagatgtggtattgtatgctaaatgtaatatagagggagaaaatatgttccgtgaccgaatgatagggggcgtttttgaaggcagtaaccaactggattttgcagtaagcgataccttgtttatcatacagtgtaaacctgatcgtttgaatacgacagtaagaagttcttcaaataaagaatatcgttatatcagatatgtaggtcctcccggaggattatgtaatgtggctgaagtcgcattttatgaaaaaaatgatactcttccattgtctgggaaaattatagggactcccggatgctatcaacatgacgggacgcatgaatatacaaatgtgtttgatggaaaaacgtggacttcttttgattattttaaattttccggaggatgggcaggacttgatttgggtagaaaggtgcagatagaccgtattgtatatactccgcgcaacagggataattatattcgtcctggtgatatctacgagttgtattattgtgatcgatattggaaatccgccggaagaattaaatctacagttgattcattagtatacagagggattccccagaatgtacttttgttcttacgtaaccatacgcgcggcgtagatgagagagtctttgtttatgaaaaaggagagcaactatggaaataagacttaaaattaaactagttgtgttgtggaagacaatcatcttattaggaataattgtcttgctatctgcttgtttccattcgaagaaggaggctgtatcttctattgctattattcctgatgagcatacgttactggcgattacgccggaattctctataaaaatggcaggaaatacattgaataaacattatctacgattgaagtctggaaagatatttccaatgacagggattttgcaggtagatggtaggacctatcgttttatgggggaagattctttacgtatatcccctatagcttctcttgcaaatgacagcgtcagttggtcagggaaatattcttatttgtttccaggaaaagggtgggagcaaaaggaatatgatgattctttttggaaagaaggaaatgcagcttttggacctgtaaaaggaaattctaagattcgtaccgcttggggggcggaaaatatatatgtccgcaggcatattaagattgataataaagatgctttggaagggcataaaatttacgtctgttatatttgcgatgatcagataaaacttttttggaatggagattttttatttgaaaaaggaataacatatcaaacgaaatgtggacgtttaacagatgaagctattgctcatattggtaatggaacaaatgttttggcagcttatggatgtaatacaggaggccctgcgttgttagattttggtctgtatattgaaaataaaacttatagtgaagcagatacggccctattgaagcaaatagatgtacaagctactcaaactcattatgtatttcaatgtggggatgtagaacttcagattgattttgtttcaccttctttgtcagagaagtggaatatgacaggatggcctgtcggtttcctttcctatcaagttcgttcagaagataaaaaggagcatacggtggaaattttgttcgatgtggatatggaatggatgtttggtaggaggaagattgatagttgggttgaacaagagtggcggtttgtcaagtctgatagtttatatttaggtctgacggcggatggaacatcgttttcatgcgatgatagtcatgttgttctgtctcaaaagttgtgtgcagaaaatggaaataaaggcatattgttaataggatacggagaagggcagaggatacaatatattggtgagcgtttacaacctctttggaatgacaatggaaaaggagaggttaaagaattaatgaaggctgttggaaacaggtatcagaaacttaaggaagaatgtaataaattggataatctgtggaataataaagcatttcaagtgggtgataagacatttgcagaacagattcttccttcatatcgtaattttatttcttcccataggtttgtgttatcttcggataataagtcattctgcttcggagatactttgggtaatgttagagatgcttataggagttttcctgctttgttattttttaatcgtgttgattggatgaaaagtttattaaatccaatatttgaatattgtgaagatgaacattggaaaagaaaatatccgccttacgatattggattatatccggttgcaagcaaacaaataaaagtggataattgtgctgaagaggctgctgcaaatatgttggtgatgacggttgctattgtggaggcagaacaagatttcagttatgctgaattgcattggagtcatttgtgtttgtgggcaaattatctggaagaaaagatgaaaggtgaagttcttccttctattgagttattagatgcaaatgacaaacgtgtgaaatgtgtgctgggattgatggcttatcataaattgattcaactaaaggatgcatatgaataaagtgaagaaatttctagcaataatagagaatttaatattcatgatattctgcatgatagtaattttgttcttggtacagttattctgtttcacatcgtttaaaattccatcagattctatgggacctgcattaaaagatggagatagaatattggttaataaaatgataaaaggagccagattgtttaatgtgtttgctgctttggataacaaagatgttactatttaccggatgccgggattggggcattttaaaagaaatgatgtactggtttttaattttccttatcagatgaatcggtgggatagcatccggatgaacgtaatgcagtattatgtgaaacgttgtatagctttgcctggggatacattggaaatcagaggaggattttataaagtgcgtggatgtcgcgaacagttgggaaattatgaagctcagcaatatcttgccgggctacagcaaccggaaaaacaaggaatcgtagtaggaacatttccttatgatcaaagcctaggatggaatattcgagagttcgggccattgcctatcccacaaaaggatcagattgtaataatgaaccatactacttatcttttatacagacaactgatcgcatgggagcaaaagaaaaaaatagaactaaaacaggaacaggtgtttattggtgatagtcttattcatcagtattgctttaaaaagaactattattttgtatcgggggataatatggcgaattcgcaggattccagatattgggggatgctgccggaagaatatattgtaggtaaagctacccgtatttggaactcaaaagaaaaatataccgatcagatacgttgggaacggattttaatgcagatcaaataaagatagaagatgttattacagaataaatatatcgttcatttattaatgctgtttggagtcattgcacttttaagtgttgtgactgtttcatcttatactattgcggtcggagatatggcatatcagaagctatatttggggcatatgtctattgtctttgtgatatgtactcttatgtctttgtgcttagattgtaagaaaaatgcattttatttatcagtcgtttggtctcttattattttaggtggggttgaggctgtttggggattaaggcagatatacggtttagctgtttctaatcattcattatatgcgcttacaggttctttctacaatccggggccttattccggatacttagcaatggtatttcctatttgtttgagtgaatggttgaatctaaaaaaggtgaagaaacgtacttggatcgagcaaagtaaatattgtgtggctttaggagtcttgctgttaattctttgtgttttaccggcaggtatgagccgttcggcatggatggctgttgcaatttctgggatatgggtatatgctacataccgttcatggggaactagtttaaggaagataggccgaaaatataagaaaagagtatttccggctattattgccgggggaatggtattgataatagttggttatgctctttttcaattaaaagtagattcggctaatggacgtctgttaatttggaaagtgagtgttatggctattgtggaaaaacctttccttggacatggtactggaaactttgcatcggcttatggaatggctcaggaaaaatatttctcccaaaaagagtttacatctacagaagaattagtagctggaagtcctgaatacgcttttaatgaatatctgcaaatagctgtagaatatggagtcttatttctattggttgtgttattgattattgttttttgcctttggataggaataacagagaaaagactaagtgcatgtgctggtttgatttctgttttagtatttgcattttcatcttatccaatgcaaatacccggatttgctatagcattctattttttattggctgcttgtgtagtgggttcttcacggttacaaatattgttctttattataatgattgctttattgggaagttactattggaaatataatcagtataatgcttgtgaagaatggtttaggtataaaatgcactataatataggcgcatttcgtttagccaaagaagggtatgagaaaatttatccggaattgaatgataggggagcatttttgtttgaatatggacattctttacataagttgaaagaatataatagttctacagcaattttgaaagaggcaatggcacatagttgcgatcctatgattttgaacataataggaaagaattatcaggctataggaaaatatgaaaaggctgaagagtatttcatacgatctactcatcggcttccgggaagaatttatccatattacttgttggcaaagctttatgcggaaccggaatatcgacatccggagaaattaaaacaggcgattcagattgtattgacgaaggaaccaaaggtacaatcgactgcaataagggagatgagagaagaagtgaaactgctaaaataaatgggtgaagaaaaaaaatgactgtacaaacttgattaatagatatttttgtctaaatttggcaaacatgatacaaacttacatacaatatataagaaattatatgtgagataatttagaataaacaaaccaataaatacgatgaaaaataattctacatggattttattgtgccttgcatgtatgatgacgctctcttgttccgacaagaagaatactgcagatgaatcggagaaaggtgtctccatagtccttccggatacgaagaatgaagtagctgttcagatattaaagaagcgtgattttcatcacgaactggtgagtaacggtaaaatcaatgcccgtggcaaagccgatctgcgttttgaaaccggtgaagtcatcgctcatatctatgtgaagaatggcgaccgtgtacagaaaggacagaagctggctgatctggataaattccgtctggaacagaaattatcccagtcggaagatgctttactgaaagccgaactggaattgaaagacgtactgatcgggcagggatattctcctgacgactttagtaaagtccctgccgaaacaatgaaaatcgccaaagtaaaaagcgggtatgaacagtcgaaatcccagtatgaactggcgaaaagagagatggagcatgctacgttgattgctccttttgacggtgtggtagccaatttattttcaaagccttataatccggcaaatacttctgaagcattctgtactattattgattccaaaggaatggaagctgatttcacagtgctggaaaatgaacttgcttttatcaggatgggagataaagtggtaattactccttatgccggaggagatgcgtttgaaggcagtgtatcagagataaatccattggtggatgccaacggcatggtgaaagtgaaagcattggtaaatgcgggaggaaaactgttcagcggaatgaatgtaagggtaagtgtccgccgttcgctgggagaacggctggttattccgaagagcgccgttgtattgcgttccggcaaacaagtggtatttaccctgaaagacggcaaggcaatgtggaattatgtgaatacgggactggagaatgcgacagaatgtgtcgtctccgacaagtcgcagaaaggtatcgaggatggtctgctggaaggagatacggtcatcgtcaccggaaatctgaatctggcgcatgaggcggaagtctatgttaaatgaagaattaagaattaaataatgaatctatgataaaattcttaattcagcgccctattgccgtattgatggcctttaccgcctgtttcatcatcgggctggtgacgtactctacgctgcctatatcgctgcttcccaatatcgctattcctgagattacggtacaggtggcgtctgccaatacctctgcccgggaattggaaaacacgattgtcaaacctttgcgggggcagttgattcaggtctctaccctgaaggatattcatagtgaatcgagagacggggcgggcattatccgcttgtcatttgaatatggaacgaatacggaccttgcctttatcgaggtaaatgagaagatagatgccgccatgaactatcttccgaaagaagcggaacgcccgaaggtaatcaaagcgagtgcaacggatattcccgtattctatctgaatctgacactgaagaatgacagtgcttacggagctacggaacagcactccttccttgaattgtgtgagtttgccgagtctgtcatcaagcgcaggatagagcagcttgaagaagttgccatggtggacgtgaccggaattttggaacggcaggtacaaatagtgcccgacaaggacaagctcgccatgatgggactctccattggagatatcgaatcggctttatcctctaataatgtggaaccgggcagcatgacagtgcgcgacgggtattatgaatacaatattaaattctcgacattgctgcgtacagcggaggatgtggaaaatatctatctgcgtaagggcgaccgcatcgtacagttaaaagacttctgcaaagtaagcgtcgtacctgtaaaagaaaaaggagtatccttgtccaatggaaaacgggcggtgagccttgccgtcatcaaacaggcggatgagaacatggataagatgaagcaggcgctggtaggcacgatgacctattttcagttagtatacccggagatcgatttcagcatcagccgtaatcagacggaactgctggactacaccatctctaatctgcaacagaatctttccctgggttttctctttatttgtctggtagcggttctgtttctgggagatgtaaagtctccgctggtcatcggactcagtatggtggtgtccatcgtgatcagctttgtctttttctacctttgcaatatgtctctcaatatcatttcacttgccggattgatcctggcattgggaatgatgattgacagttcgattattgtgaccgagaatatatcgcaataccgtgaacggggatactccttgcgccgtgcctgtgtgacgggaaccagtgaagtggtcacccccatgctgagttcttctctgacgactattgccgtctttgccccgctgatttttatgagcggtattgcaggcgctattttctttgatcaggctttttccgtcactgtaggcctgatggtgtcctatctcaccggtatcatgctgcttcctgtgctttatctgctggtttaccggacaggtgtccgcacccggaaatggaagtggctttctttcaaatttaataacccgatcaaggatcacacgctggaccgcttctatgatgcgggtgttgactgggtattccgccataaaacgttcagtgtactgttctgtgtgatttccattccgctttgcgtattcttctttttctttatagacaaagaacggatgcccgatatcgaggagaatgaactgatcgcccggatagaatggaatgagaatatccatgtggatgaaaacaaacgacgggtggatgaacttttcaaggaactgaaggatgaagtactggagcaaacagcctctatcggcagacaggatttcatcctcaatcgggaacgggaactgtcttcttccgaagcggaactttatttccgtacggagacttccgatgctattgcccctttggaacaggcggtatatcggaaactgaaggaacgttatccgctctctgtcatttctttctctccgccggaaacggtatttgagaaactctttgtgacgggtgaaccggatgtggtggcggaattttacacccgtaataaagcggaagcccccaaagcggaagcaatccgcagcatggaacaggaactgggacgaaaaaccggaatcaatccgacaggtatcgccttcgaaaaccagttgaatctgagtatcagtaaagagaaactcttgctctaccgtgtttcctacaacgaactgtatcgggtactgaaaacggctttccgggaaaacagtgtgacgatgctgcactcttatcagcaatatttgccgatcaacattgccggggatgaaaagactgtgaacgaggtgttgcaggaaacactggtgcagacgcaaccggacaaccgtgggaatgtcgattttatcccgcttcgggaattgatcaacgtagctcccgccgaagacttgaaaagtattacttccggacgtaatggcgagtatgtcccgttcgacttttacggcgtgcaggatgcgaaccggctgatgcgtgaagtgaaacaggtggcggaggaaacaggggactgggatacgggcttctccggcagtatcttctccaacaaggagatgctggatgaactggtcgtgattctgttgatctcactgctgctgatgtatttcattcttgccgcacagttcgagagttttctgcagccgttgctggtactggcggaaatcccgattgatgtggcatttgccttactcttgctttggatatgcgggcatacgctgaatctgatgtctgccatcggtctgattgtgacctgtggtattgtaatcaatgactctattctgaaactggatgcgatcaatgaactgcgcaaggcaggcgttcctttgctggaagctattcacgaagcaggccgcaggcgtctgcgtccgattatcatgacttcgctgacgaccatctttgccatggtgccgttgctgttctcctcggatatgggatcggaactgcaaaagccgttgtctatcgccatgataggcacgatgtccatcggtacggcggtcagcctctttatcataccgctgctttactggtttatctatcggggaaaaagcgggaatcacaaaccaaatgaaaaacatgttgaattatgaagaaatcatccgttctttttgtattgatggcagcatcggggatatgtttctcttcagtatatgcccagaaacgtctggtgctggacttgaaccagactatcgctttagctaacgacagttcgctggagtcattccgcacacaaaatatgtatctgtccggttattgggaataccggacgtaccgggcaaaccgtttgccgagtctgacaatggaccttaccccggcacaatataaccgggatatcacgaaacgttatgattcgggacaggacctggatgtctaccgtacgcaacagtcatattatgcctatggaggattaagtgtccgtcaaaatctggacctgaccggaggtacgttctatctggagtcgaaccttgcctatatgcgtaatttcggggataatagtgcgacgcagtttaccagcgtcccgatacggctcggttattcgcagagcctggtcgggtataatcctttcaaatgggaccggaagatcgaaccgctgaaatacgagcgtgtgaaaaaggaatttctttataatgtggaaaaggtttcggaaacggcgacgaattatttcttttcgctggcgatggcgcaggcggaatacaaactggcaaaggaaaacctcgcatctacggatactttgtaccgcatcggacagcaacggcaccggatcgccgctatttcacaggcggacctgttgactttaaagctggataaagtgaatgcacagaatacattgcagaatagggcaagcgccttgaaacgggcaatgttctcactggcatcttttctgaatctggataagaatacccagatcgaactggagcttccttcacgcccaagtatgatggagattccggtggatgaggctttgagatggggaaggagcaataatccgcagttgctggaactgaagcagaatgtactggaagcggagcggaatgtggacagaacaaagaaggaatcccgtttcaatgccagcgtgaatgccagtatcggtttcaaccaggtggcggaaagcttcggagatgtgtatcataaaccgatgcagcaggacttggtagcggtcagcgtatcgattccgctgctggactggggcgttcgtaagggcaaatacaacatggcacggaataatctgaatgtagtgaagatttcggcacgtcaggatgagatcagtattgaggaggaagtaatcatgacggtgagtgattttaatatccagcagcagttgattgccagtgcggaagaagcgctggacctggcgatactggcttataatgagacaaggcaacgttttattatcggtaaagcggatattaatagtctgacgctttcgctcaacaggcagcaggaggcgcagcgcaactacatttctgccttgcagaactactggctgaattattataaaatacgtcgtctgactttattcgattttgctacgaagctttctctttcggatcgtttcgactttaatggagggagactgatcagatagtaatttcttttgggatatagacaaatgaatcatgcaagatataggttctgaaattaaaaagtcatcaaaggcttccgcttttacgctcattgtcgcttttatcagcgtggcgttggtcgggctggcacttgttccgttgctgccggtgaagctgaatccgtcacggaccttacccggattttctgtgtggttcggcatgggagggacttcggcgcgtgtcgtggagatgacggctaccagcaaactggaggcgatgcttgcccgtgtcaagggaatacaaagcatatcttcgacttccggcaatggctggggaagtataaatgtgagtctggacaagcatgcagatgcggctgtcgcacgttttgaggcttcgaccatcattcgtcagacttggccggaattgccggcgggagttagttacccgtacattcagatggcaagtccggagcagaaaagtcagggaccttttatcgcattcacgattaatgcgcctgccactcccagtctgattcagaagtatgcggaggaacatataaagacacgccttgcgcagcttccgggaatctataagataaacgtcagcggagccacaccgatggaatggcgtctggagtatgattatgagcagttgcgtgcgttgggggtgagtacggatgaaattagtcaggcagtcggtctgcattatcagaaagagtttctggggacttatgatgtggaacaggcggcttcgggcaaggaatggattcggttggtgctgatgcccgaacatgataaccgggagtttgacgccgggcagatacaggtgaaagtgaaggatgggagaatcatccgcttggacgaactggtgaagggcgtccgtatggaagagcagcctcagagctattaccggatcaatggactgaattcgatttatctgtctgttgtcgctgaagaggcggctaatcagctggaactgagcaaaaaagtacaggcgtgtatggatgatatcagactgtcgcttccggcgggatacgagattcataccagttatgatactacagagtttatacatgacgagctgaacaagatttatttgcgtacgggagtgacggtggctatcctgctcttgtttgtactgctgattactttcagccccaaatatctgtttttgattgtcaccagtctgaccgtgaatatggcaatagccgttatcttttactatgtcttcggactggaaatgcagttatattctttggcgggtatcacggtttcactgaacctggtgattgataatacgattgtgatgagtgatcattatcttcgatgtaaaaaccggaaggcgttcatgtctgtattggcggctacactgacaacaatgggagcgttggtcatcatcttctttctggacgagaggattcgtctgaatctgcaggattttgccgcagtggtgatgattaatctgggagtttcattattggttgctctgttctttgtaccttctttgattgataaaatcgggttgaaacgacgcaggaagtcttctctgaccggagtgaagagaaaatggaaaatggggaatacccgtttcttaggatggctgcgttcgaagatgcgaagggggccggtctatttctgtcatttctacaggtggctgatacagaggctttgccgctggagagtagcggtttgtctgttgctgttactggcattcggattaccggtctttctgttgccggaaaagatggatggggatggcaaatgggcagagatttataataagacactggggactcctacctataaggaaaaggtgaaaccgatagtggataaagcgttgggaggaagtctgaggctgtttgtgcaaaaggtgtatgaagggagctactttacccggaatgaggaggtggtgctttatgccaacgccaatttaccgaacggcagtacgcttgaacagatgaatacactgatcaagcgaatggaaacttatctgagcgagttcaaggagatcaagcagtttcagacatcggtagaaagcgcccgcagggcatctatcagcattcgtttcacaaaggaaaatcagaaaagcgggttcccatatacgctgaaagctaacatgatcagtaaagctctccagttggggggaggagattggagtatctatggattacaggatcagggattcagtaatagtgtacgcgagaacgcgggatcattccgggtgaaaatgtacggatataattatgatgaactttatagctgggctacaaaactgaaagaggtcttattgtctcatcgccgtatcagggaagttacggtcggttccaatttctcgtggtggaaggatgattatcaggagttttattttgagctggataaacaacggatgatcggagcggggatcggagccggagaactgtttgctgctattcgtcccatatatgggcggaatcaggaaatcggttccgttgttaccgaagatggaacggaaaaaatcaaactctcttcccgccagtcggatcagcgggatatatgggccatgcagtattatcctttccgtgtaggcgataaagagtataaactggcggaactggctaaggtagagaagggacagatgccgcaggaagtggcgaaggagaatcaacaataccgcttatgcctgcaatatgagtatatcggtgcgtcggaacagggaaataagttgctgaaaaaagacctggaagagtttaatgaacttctcccgatgggatataaggcggaagcggaaagtaataactggtcatggggtggaggtgccaacaaacagtatcgcttgctcctgattgtgattgctatcattttctttattacaagcattctgttcaattcgttgaaacagccgttagcgatcatctttgtcattccgatctcttatatcggtgtgtttctgacgttctactggttcaagttgaactttgaccaaggtggtttcgcttcgttcattctgctctgcggtatcacagtgaatgccagtatttatattttaaatgagtacaatgcgattcgaaaacgctttccctgcctttcttctcttcgtgcttacgtgaaggcatggaatacgaaagtgatccccatttttctgacggttgtttctaccatccttggctttatcccctttatggtgggagcagagaaagaaggtttctggtttcctttggctgcaggtactatcggtggattggtaatgtccgtgatcggcgtgtttattttcttgccggtactgactttgaataaaaagaagatgatggtgaagaagccttgaagaaataaattagctattagcatatttcgattagctaatagctaatttgtttttgctaatagctaatcgaaataaggtataggagataattcaccagttatttcctgcattgctgctgccgatcagcatttctacccgttgcttatacaagttggctccctcagcgatgttctttcccgcatctgcggttcccattccgtaaacaacaacaggcgtttgccacgacatccccgaatgaatggcactaacctgataaggacgtaaaagctcatccactgtgaagcggtttctgcctccgctacggtatgcttcatattcggaacctgtggtggttactactgtcaatggtttcccggctactgccggagtcttggaaaggaaggtgaatacttcgtcctgccattttttgagcaatgacggcgcagccatccaatgaaagggaaattgataaatgagggcggaagcatcggaaatgattttgctccattcgtcaacatcaaaagaagcgccttgctggtcgtaaagattgaatactgctacgccttcaatatcactcacagcatcaatcagtgctttgtttgcttgtgattccttcatattgggatgcgccaggagaatcaccacttttcttaaatctttattcataatcaatcgggtatttaggatgaaacaactacatctataatataaaggtctaaaaataagaaaaagttttcgaaactcaatatcttaattaaaaataaaagaatctctctttgcttttgaatttgtatttttgcaggcacgtccgtaaggcgttattttagataataaatttatatatgatagatttcacccaatttccttctccttgctatattatggaggaagaactcttgcgaaagaacctgtgtctgataaaaagcgtagccgacagggcaggagtagagattattctcgccttcaagtcattcgccatgtggcgttcatttccgatattccgcgaatacgtggagcattccacagcaagttctgtgtatgaagcgcgtctggcattggaagaatttggaagtaaagcccatacttattctcctgcgtatacggaacaggattttccggaaatcatgcgttgcagcagccacatcacttttaattcaatggcacagttccgtcgtttctatccgatgacagtggccgaaggaagcggaatctcctgcggtatccgtgtgaatcccgaatattcggaagtagagactgaactttataatccgtgcgcacccggtacccgtttcggaatgaccgccgacttattaccggataccttgcccaaaggaatcgaaggtttccattgtcattgtcactgcgaatcttcttctttcgagctggaacgtactttacagcatctggaagagaaattctcccgctggttcccgcaaattaaatggctgaatctgggaggcgggcatctgatgacccgaaaagattatgatacagaacatctgattaaattattgcaagacctgaaagcacgatatcctcatttgcagatcatccttgaacccggttctgcttttacatggcagacaggagtcctgacttcggaagtggtagatatcgttgagagtcgcggtatcaagacggctattctgaatgtgagtttcacctgccacatgcccgattgtctggaaatgccttatcagcctgccgttcgtggtgcggagatggggaatgaaggagaatttatttatcgtttgggaggtaattcttgtttgagtggtgattatatgggattatggagtttcgatcatgagttgcagatcggagaacggattgtgttcgaagatatgattcactatactatggtcaagacaaatatgtttaacggaatccatcatcccgccatcgctttgtggacaaaagaagggaaagcggaaatatacaagcaattttcttatgaagactatcgggaccgaatgagttgataatcaaaacaattgtttgtttgcggaaacaaagtgtgcagattcttgtgaaaaaaagatgcagaatgtttgcagaattacggaaaatccctacctttgcaaccgcaaacgaaaaaatgcggaaatagctcagttggtagagcataaccttgccaaggttagggtcgcgagttcgagtctcgttttccgctcatgtttctttgaaatgttggaaatataatctttgcccaggtggcggaattggtagacgcgcacgtttcaggtgcgtgtgtcgagaggcatgcaggttcgagtcctgttctgggcacaaagattttaactttaaaattctggagaggtggcggaattggtagacgcgctactttgagggggtagtgacagttatgtcgtgggagttcgagtctccttctcttcacagtcattaaagttatttgcggaaatagctcagttggtagagcataaccttgccaaggttagggtcgcgagttcgagtctcgttttccgctcatgtttctttgaaatgttggaactaaattttgcccaggtggcggaattggtagacgcgcacgtttcaggtgcgtgtgtcgagaggcatgcaggttcgagtcctgttctgggcacaagaaattcagatttctgaatggagaaaatttagtttgcggaaatagctcagttggtagagcataaccttgccaaggttagggtcgcgagttcgagtctcgttttccgctcaaagtagtgaggttgtcagtcgataagattggcgacctctttttgtaattacgaaagtcgatgtacttcccccaaaaagagtgtcatcgactcacacagacctataattaatttaagaacttgtgatatgttaacacaaatcattaatgcgcgcatccttacccctcagggctggttgaaggatgggtccgtacttattcgtgatcataaaattctggaagtgactaactgcgacctggcggttatcggagcaaaactgattgatgccaagggcatgtatatcgttccgggaggagtagaaattcatgttcatggcggtggtggaagagactttatggaggggacggaagacgccttccggacagcgattaaagctcacatgcaacacggaactaccagtattttccccacactttcttcttctactattcctatgatccgtgcagccgcagaaacaaccgaaaagatgatggcagagccggacagtcccgtactcggcctgcatctggaaggacattacttcaatatggagatggcaggcggacagattccggagaatatcaaaaatcctgatccggaagagtatatccctttgctggaagaaacccattgcatcaaacgttgggatgcggcaccggaacttccgggggctatgcagttcggaaagtatatcaccgcaaaaggcgtattggcatctgtaggacatacacaggccgaatttgaagatatccagactgcgtatgaggcaggatatacgcatgctacccatttctacaatgctatgcccggatttcacaaacggaaggaatataagtatgaaggtacggtagaaagtatttatttgattgatgatatgacagtggaagtcgtggccgatggcattcatgtgcctcctaccattcttcgtctggtctataagataaaaggagtggagcgtacgtgcctgatcactgatgcgctggcttgtgcggcaagtgacagtaagactgcttttgatccgcgtgtcattatcgaagacggtgtgtgcaaactggcagaccgctctgcattggcaggaagtgtggcgacgatggaccgtttgatccgtacgatggtgcagaatgctgaaattcctttggcggatgctgtgaggatggcttccgagactccggcccgtatcatgggagtgctcgaccgcaaaggtacgttggaacgtggcaaggacgcggatattattgctttggatagagatctgaatgtaagagcggtctgggcgatgggacaattggtagaaggtacaaacaagctgttttaacgactaaaaaagaaaacgatgttaactcaaataatcaacggtagaatacttactccgcaaggctggctgaaagacggctctgtattgatttgtgatggaaaaatattagaggtaaccaacagtgatctggcagttatcggtgcaacagtgattgatgccagaggaatgacgatcgtaccgggatttgtcagcatgcatgcgcatggtggcggcggccatgattttaccgaagcaacggaggaggctttccgtatcgcagcaactgctcatttgaagcatggagctaccggcatatttcctactttgtcatctacttcgtttgagaggatatatcaggcggtcgatgtttgcgagaagctgatgaaggaaccggagtctccgattctcggtctgcatatcgaaggaccttatctgaatccgaagatggcaggaagccagtatgacggttttctgaaaactcccgatgaaaatgaatatgtgccgctgttggaacatacttcctgtatcaagcgctgggatatcagtcccgaattgcatggggcacatgattttgcaaaatacactcgttccaagggaattatgacagccgttactcatacggaggctgaatatgatgagattaaggcagcgtatgcggtaggattctcgcatgctgctcatttctataatgcgatgcccggttttcataaacgtcgcgaatataaatatgaaggtacggtagagagtgtatatctgacagatggaatgacggtagaagttattgcagacggtattcacttgcctgctactattctgaaactggtttataaactgaaaggggtagagaatacttgtctggtgactgatgcgttggcttatgctgccaatgaagggaacgagccgattgatccgcgttatattattgaggacggagtatgtaaaatggcggatcattctgcattagccggtagtctggcgactatggatgtgttggttcgtacgatggtgaagaaagcaagtattcctttggaagatgctgtgcgtatggcttccgaaactcctgctcgtctgattggtgtgagcgatcggaaaggggcattgtctaaaggtaaagatgctgatattgtgatacttgataaggaattgaatgtacggtgtgtctggtcgatgggaaaagttgttccggggacagataggttgctgcataaatgataagtgctatctgttaaatctgaaaatagaaagtccgaacctttaaattgcaaaaagcaattgggattcggactttttcagtaagaaaagtagtaatgtgagtactctatattctattttatcatgaaaatagagtcgtttctataaactctttcaattgaaccttattcattgtaccgagtttcattatcggtttgccattcaccgggcaaagcaaaaggttgggaattgtccgaatcttgaatgcactttccagttcctcttcctgatcgacgtctactttataaatgtccagtctccctttatattcttctgctaattggtccaatatgggtgataatgccttgcaataaccacaccatggagcatgaaaatcgactaaacaaggtttattccctttatattcccaattatccggataagattgataatcagcaactttctcaacaaagctttctttggttaaatctataattttcatatttcctgtttttaatgattcattatttatttctactttgcaaagataggggtatggtagagaaagagggatagccattcttcctgttgtgtttacaatttttcctttccctagatattttctaatcaaattctaatctgaaatgagagccttataatcgcttttatccagcctctaccgttgcagagttgtacttttgtcggaaaacaaattaaggtaacaaaaagattgcgatgaacagagcatttttatttttactatttcttctattggcaggaaagatgtgtgcgcaacaggttgcaggcacattgacactgaaagaagcagagcagcgttttttagagcgcaatttatcgttgatagccgagcggtacaatatcgacatggcacaggcgcaggtattacaagccaaattgtttgaaaatccggtcatttcgctggaacagaatgtctacaaccgattgaacgggaagtattttgattttggaaaagaaggggaagctgttgttgaaatagaacaagtgatccatcttgccggtcagcggaacaagcaagtccggctggaaaaaatcaataaggaaatagctgaataccagtttgaggaagtaatgcggacgctccgtcaggaattgaatgaaaagtttgtagaagtctactttctttccaaatccattgccatctatgaaaaggaagtaaattccctgcaagtacttttgggcggaatgaaagttcagcaggaaaaggggaacatctctttaatggaaatttcccgtctggaatcgatgctcttctccttgaagaaagagaagaacgaacgggagagtgatttactgactaccaggggagaactgaatttattactgaaccttccggaagatacacaagttcaactctcattagacgaagaagtactgcaacaactggacctgtcgcaattatcatttgcagacctgaaagcaatcatcaatgaacggcccgaccaaaagattgcccgaagcacagtgaatgcctcccgtgcaaatctgaaactacagaagtcaatggcctttcccgagttctcagtgaaagggaattatgatcgtgtcggaaactttatcaatgactatttcgcgataggagtaagcctgtccgtacctatcttcaaccgtaatcagggaaatatcaaagcagcccgcttcagtatccagcaggcgggagtgcagcaggaatatgccgctaatcgtgccgatatggaacttttcaccgcttatacgtctctggagaaagcaactcaactctatcaatccactaatatggacctggaacgtaacttcgagaaattgatcacaggagtcaatgagaatttcaccagaaagaatatcagcctgctggaatttatcgactattatgacagctataaagaaacctgtatccaactatacgagataaagaaaaacgtatttctcgctatggaaaacctgaatacagttgtcggacaaaatgtattgaactactaataaaccgaccaatatgaaacgattaaagatcacaatccataaattatcaaagactatgaactggaataaatttcttccttgtatattgtttggcagccttttgggagcatgctccggaaaaggagaacaacccaaagtagaaccgactacactatgcctgacggacagcctgctgagaatcgtatccgtcgataccgtgcacgtctgtgaagtggtagatgaactgacattgaatggacgggtcactttcaatcaggatcaggtggcaaatgtgtatccgatgttcggaggaaccgtgacggaactgcgtgccgaaataggagactttgttcacaaaggagaagtgctggcagtgatccgtagcggggaagtggcggattatgagaaacaattgaaagaagctgaacaacaactcttgctggcccggcggaacatggatgccacacaggatatgtacacttccggcatggcatcggataaagatgtacttcaggccaagcaggaactggcaactgcggaagcggaagaaagacgaatcaaagaaatattctccatttatcacttctccggaaatgctttttatcagctcaaatctcccgtatcaggctttattgtggaaaagcagatcagcagggatatgcagctgcgccccgatcagggggatgcgctgtttacgatttccggtctgtccgatgtatgggtgatggcggatgtgtatgaaagtgatattagtaaggtttccgagggagctgacgtccgtatctcgactttggcatatccggaaaggacatttacaggtacgatcgacaaggtctatcatctgctggacagtgaaagcaagacaatgggcgtacgcatcaaactgaaaaacgaagattacctgctgaagccgggtatgtttacaaatgtgagcgtaaaatgtaaggcggaagatacttccatgcctcgtatcgactcccatgcactggtgttcgagggaggaaagaattatgtggtcatagtagagcctgaccagcgtctgaagataaaggaagtagacgtttacaaacagttgagcaaggaatgttatgtccgttccggtctttccgaaggagacagggtactgaataataatgtattgttagtgtataatgctttgaatgcggattaaaaatcagagaatagtatgcataaattcatagataatatagtagccttctcgctgaagaataaattctttatattcttctgtacggtgattgccgttatagccggagccgtctcattcaaacatacgccgatagatgcctttccggatgtaacgaatacaaaagtgacgatcatcacgcaatgggcgggccgtagtgcggaagaggtggagaaatttatcacgattcccattgagatagccatgaatcccgtacagaaaaaaacggatattcgttcgaccactcttttcggactttctgtgatcaatgtaatgttcgaagatcgtgttgatgactttacagcccgtcagcaagtctacaatttgctgaatgatgccgatcttcccgaaggcgtgactcccgaagtacagcctttgtacggacctaccggagaaatctatcgctacaccctgcgcagtgacagacgtagtgtacgcgatttgaaaacgattcaggactgggtgatcgaacgaaatctccgttcggtatcaggtgtagctgatatcgtcagtttcggtggcgaggtgaagacattcgaagtgagcgtgaatcctcatcagttgattaattacggaattacctctctcgaactttatgacgcgatagccaagagtaatatcaatgtaggaggagatgtcatcacgaaaagttctcaggcatacgtagtccggggaatcggtttgataaacgatctggatgaattgcgaaacattgtagtgaagaacatcaacggaacgccgattctcgtaaagaacctggcagatgttcacgaatcctgcctgccccgcctcggacaagtgggacgaatggatgagaacgatgtcgttcagggaattgtggtgatgcgtaaaggggagaaccccggtgaagtcattgcaaatctgaaagataagatagaagaattgaatcagaatgtacttcctgaagatgtacggataataccgttctacgaccgtgaggacttggtgaacctggcggtaaaaacggtgacccataatctgattgaaggaatattgttggttacgtttattgtgttaatcttcatggcagattggcggacaaccgtgattgttgcggtgattattccattagctttgttattcgcatttatttgtttacgcgtgatggggatgtctgccaatctgctttctatgggggccattgactttggtattattatcgatggggcagtggtgatggtggaaggtgtgtttgtcgctttggacaagaaggcgaaagaggtgggaatgcccgcattcaatgtgatgtccaagatgggactgatccgtcataccgccaaggataaggcaaaagcggtatttttctccaaactgatcatcattactgccttaattcctattttctcttttcagaaagtggaaggaaaaatgttctcacctttggcatatacattgggttttgctttgctgggtgcgcttattttcacattaacgctggttcccgtcatgtcgtccatgttgctgaaaaagaatgtacgcgaaaagaacaaccgctttgtccatttcatcaatcaaaagtgcacggctctttttgataccttctatgctcatcgcaagctgactatcggactggcaaccgtagttgcaggagtcggtttatggcttttctctttcctcgggacggagtttcttcctcagctcaacgaaggttcgatctacatccgtgctacgctgccgcaaagtatatcgctggatgaatccgtaacgctggcaaataagatgagaaagaaactattgactttccccgaagtgaggcaggtactgtctcaaaccggacgtcccaacgacggaacggatgcaaccggattttataatattgagtttcacgtagatatttatccggagaaagactgggaaagcaaactgaccaaactgcagcttatcgacaagatgcaggaagatttatccatttatcccggcattgactttaacttttcgcagccgattacggataatgtggaagaagcggcttccggtgtaaaaggttctattgcggtgaaagtgttcggtaaggatttgtacgaatcggaaaaactggccgtccagattgataagatcttaaataccgtgcagggaattgaagacttgggagtgattcgcaatatcggccagccggaacttcgtattgaactgaacgaacgtcagttggcacgttatggagtggctaaggaagatgttcagtctatcattgaaatggctattggcgggaagtcagcttcgctgttgtatgaggacgaacggaaatttaatatcatggtgaggtatagtgaagagttccgtcagaatgaagaggagataggtaagatactggttccggcgatggacggaacgatggtgcctattaaggaactggcagatatcactacgattacaggaccattattgatcttccgtgacaaccatgctcgtttctgtgctgtcaagttctcggtgagaggacgggatatgggtacggcagttgccgaagcgcagaaaaaggtaaatgcttccgtccatttaccggctggatattctttgaaatggacgggtgattttgagaatcagcagcgtgcttcgaaacgtctggcacaggtagtacctatcagcattgccattattttcattattctgtttattctcttctccaatgcaagagatgcaggactggtattgctgaatgtaccgtttgctgccgtgggaggtatcgcagcccttctgataacgggcttcaatttctctatatcggcgggtatcggttttatcgctttgttcggtatctgtatacagaatggcgttattatgatttccgatatcaaggcaaatctgaaactgggttcgcctttacaggaggccacaaaagaaggagtccgttcacgtatccgccctgtgataatgacggcggctatggcagctatcggtctgttgcctgcggctatgagtcatggtatcggttcggaatcacagcgtccgttggcgattgtcattatcggcggattgataggagcgactttcttcgccctgttcatcttcccgctgattgtggaagtagtgtatgaacgaatgctatatgataaaaacggaaaattattgcaaagacgtatctaattcattttctattctttctatgaaagaaacggcatagattaaattttaatttcgttttcagtaggtagaagtgaggaagggacaaaagtcggttgaatcagaagatcacccgtacttttgttcctttttctatttccgaagatatttccagcctggcgttgtaggcagatactattttcagagtcaggctgaggccgatgccctgacccgcatagtcatgtgtgttgctgccccgatagaaagactggaatatatgttctatttcttccggaggaatgccgatgccctgatcttttatttcaagaacgaggtgttgatctttacggctgagtgtaatgtctacttccttttctgaatatttgcaggcgttatcgatgatattctttaaagctattttgagcagataaggattggcctttacagtggcagccttacctgtttcttcatgatggaaccggattcgttcgttcgtttttattaagtcattcagcatatccggtagagacactgcctccatattgctttttaagagctcttcatcctgacgtgaaaggaaaagaagatggcggatcagattggagattcgcttgctttcggatgagattcgttgcagggcttcgatatattctccggtacttctttctttcagcagactgatttcgcattctccctgtatggcggttatggggttgttcagttcatgcgaagcatggctgacaaaggacttttcagctttgaaagcactgtccagacggtcgagcatgctattcagtgttttgatcatgtcttccagttcatcgttgtttccggtcgtctttaaccggcggttcagactgttggctcgtatcctcttcagctccttcagtatatgttgcagggggataagaatacggccggaatagattttcccgactaaataaatcaggatggaactgaataaaaccagaaagatggagagaagcaagaggtgttctttgatttctgcaccgtacacattccgggacatgacgaggacgatgaaattcccttcattatcgggataataaagggcggctcccaactggtctttgtatttaaaagaaaaagggatgctgtcttcaccggctatcagaagtgcctgctgatgctgggtcagatatttgttcagagtgtcacggacttcggagagactgtccatatttaaaagaatctcatgagcttcgggcaggagttcgtcatatttgcgctggataatctggtaactctgttcgtctacttcgtctttctcccagtgcttttgtgcggtcagatatgctttttcacgaaggtaggaggcatagagtttattgataaactgtgtgctgaaaagatagaatacggcaataatgatgatagttgtcagtacactgagcaacgtatagaagagagctattttagaacctattttcatacacggatttatttgatggatgttcaggcattcatgatatatcctaatcctactaccgtatgaatcagtttcttgtcgaagtcacggtctatctttacccgcagataattgacgtatacgtctacgatgttggtattcgtatcaaagttcttgtcccatacgtctttgagcagcgtaatgcgtgacaaggctaccccctggtgagttatgaaatattcgagcaggcggtattcttttacggtgagatcgatatccgcatcacctctttttgcccgtctggtgttacagtccaataccagattgtcgcaagtcagttgattggttacagcctccttgtttcgtcgcagcagcgccttgatacgtgcttccagttcctgaaaactgaaaggcttgacgagataatcgtctgctcctgcatccagtccttttacaatatcttccgtagtgcctaaagccgtcagcataatgaccggtgtctggtaaccgaacatctgccgatagagatggcaaagttcgagcccgtttattttcggcatgataatatccagaattacaaggtcgaaaggttcttcctgaaggattctccaacccgtatttccgtcatgacagactgttaccgaatgtccgaactctttcagtccccgttcgataaaggaggcgatattgacttcatcttctgctaatagtatctttgccataaatctacattgtttagatgcaaagatactttttctttgtatccgaagaaagaaaaacggcatacatttaagtgtttctcctttctgaactgtattatatataaacagacgattatactatgaaagtaaaacatttagttggagcttttctgtgtgtgctgggatgctatgcctgtagtagcccgaaaacagaggtccagtcaccggacggacatatcaagatgactttgacagtagacgaaaacggcaaaccgttttataatgtgtcggtggatgactccctcttgatagaaaattcaaccatgggctttacggcggctaacggcatcattctgggagaaggttttcaggtgaagaacacgactttcagcagtgaagacgaaacttggacacagccgtggggagagaataaaaagaaccggaatcattataacgaaatggcagtcaatctgacaaatgaagatcatgtacaactgacgcttcgttttcgtgtatttgatgatggaatcggtttccgctatgaatatacggtaccgactgtagattctttattgataaccgacgaactgactactttccgtttccatcgtgacggaacttcgtggtcgattcccgccagtgccgaaacatatgaactactctatcaacaacaaccgatttccgaagtggaaacggccaatacacctttcacattcaagactgcggatggagtttacggaagtatacacgaagccgctttgtatgatttcccggaaatgactctgaagcaaatcggtcattatacattgaaagcggaacttgccccgtggcctgacggcattaaggcgcgtaagggaaatcacttcacgacctcatggcgcaccgtacagatcgcaccggaagctgtcggtttgatcaactcttcgctgattctgaatctgaatgatccttgcgtactggaaactacggactggattcgcccgctgaaatatgtaggagtatggtgggggatgcaccttggcgtagagacctggaagatggacgaacgtcacggagctactaccgccaatgcaaagaaatacatagattttgccgcagccaatcatatcgaagctgtcctgttcgaaggttggaacgaaggttgggaaagttggggcggtatgcagagctttgatttcaccaagccatacgcggatttcaatattgatgaaatcgtacgttatgccaaagagaaaggtgttgaaatcatgggacatcatgagaccggagggaatattcctaactatgaacgtcagatggatcatgccatgcaatggtataccgatcatggtatccacatcctaaagacagggtatgcaggcgcatttccggatggatatctgcatcatagccaatacggtgtcaatcactatcaacgggtagtggaaactgccgcccgtcatcaaatgactctggatgcacacgaaccgatcaaagataccggtatccgtcgtacatggccgaatatgatgacacgcgagggggcaagaggcatggaatggaatgcgtggagtgaaggcaatcctccttctcatcacgtgatgttaccgttcacccgcctgctgtccggtccgatggattatacgccgggaacttttgatattctgttcttgaaaacgaaggattctccgcgccgacagaagtggaacgatcaggataaaggcaatagccgtgtgaatacgacactggctaaacaactggctaattgggtaatcctgtattctcctttgcagatggcttcggatatgatcgagcattatgaaggacatccggcattccagttcttccgtgatttcgatccggattgtgatgaatcgaaagcactggcaggagaaccgggagagttcatagcagtggtacgtaaagcaaaaggcaattatttcctgggagcagctaccaatgaaactccccgtactttagaagtaaaactggacttcctggaaccgggcaagcagtataaagctgtcatctatgcggatggcgaaaaggctgactggaaaacgaatcctaccgattataagattacggaacagattgtaacatctgaaaatacgttaagtatacggatggctcccggaggcgggcaggctgtttcgtttataataggtaataagtaataggtaataggtaacaagtaataggtaataagtgagggtattaaaggaggttgttaaagtagagagattgtcggaggataacaaggtaaaataaagttggttaggttagactgaaaaaacggtggacagagttttgatacctgttcaccgtttttgtttttattgagtatggttttgaaaggatgtgttatcctttcgcttcctgatacataaagcgtttgattgatttcttcgcagtcttttcaaattcctcgaagtggattttgactttgcttatctgagaataattgggaagctgctgattcagttcaatacgattggcttccataacttttataatatcggtctgttgcaagccatgggcaaaagcatcgtcaaagtccggataaatcagtgcgaccaacttgtcgtgctgcaaaacgatcagtgactcggcaacgtaaggcatattattcagtttgctttctatctcttccggatagatattctgtccgctggaagtcagaagcagattcttgctacgaccgcgaactgtcacatatccttcgtcgtcgattgtccctaaatcacccgtgtgaagccatccgttgacatcaataatttgtgccgtcgcttccggatttttataatatcccagcatcatgttcattcccctgcatacgatttctccggcatgtgttttagggtcgggcgagtcgatgcggacttccattcgggtggttgccttgccgcaggaagccagtttcagtgtttcccaacggctggagcaaataatcgggccacattcggtcataccgtaagcgatggtgtagggaaagcctatctttttgaggaacgcttctacttcggcattgaaaggagcaccgccgataatgatttcatcgaagttcccaccgaagatttccatagcagcctgtcgcgccaacgatttgattttatcgtttacaatgggcactttaagcaatagtttaccgattttgctgtccactctcggaagaatatcttttttgataattttctctacgatcaaaggtacacaggagatcactcttggctttatttctgcaaaagactgcgcaataatcttcggagacggcatacgtgtcaggaagtaaatgtgcgctccggcagagaaaccatataagaaatcgtataccatgccgaatacatgacccatcggaagcatggaaacgatgtgatcgcccgctttcacgggaagcatctcgaaacagtatgccacgttcgaccaaatactgcggtaggggagcatgactcctttggaatatccggtagtgccggaggtataattgatgatagccagttcttccggacggtccttccggtaacagatatgttcggggcggaaattcttcggataacgctgaccgtaaatagcgttccggtgttcgaaggcgtaagtcagtttctcgttgcgcgataccaatgcagtgaaatcggtgagtgaagcgataccttccagtagcggcattgcgtcttcattcagattttcccatgcctgatcgccgacaaagagtaatttggcttcggagtgattgacgatattatgaatattatccgctttgaactcatgcagaataggaacgatgacggctccgtaagtgatagtggctaagaaggtgactccccaatgggcactgttccggccgcagactgctattttatctcctggctggataccggcactttccaatacaatgtgaaacttggctatcttgcgcgctacatccttatattgaagcgtgattcctttgtagtctgtcaatgcatctttatcccagtttttaatgatgctctgttcaatataatcaatgaactgatgttcttgttccattcgatttttgcacatttgatttaaaattgcgcaaaaataacatttcattaacggaaaccgaagtttacaattaagttttacggttaattaacgggggaggaaaagctgactaaaaagtcagtagtaccttaaatggggctgactaaaaagtcggtagtatcttaactctcctccttcgggaaggaggagtccccgtagggggaggtggtaggtgaacacataactctgttgtttacaatagaataggaataaaccttattttacctaccaccccggctttcagccacctctcctttccgaaaggaggggaattggagatactattgactttttagtcagtccctataaacatcaggattcgctgttggcttcctcgtcctctttgggcttttcggagatgagcagcaatttatcgttcacatgcagtttcagcgttccgttcggtatcaggaactcatccccacgtttcacaatcattactagcgtgcctttggggagattcatatctttcagcgtatctgcctcttccagcatttcctgtgtgatagtcatatctttgaggtctgtatcaatctcttccggaagttccactccgaaatcattccccgtcttttccagcggtttggacagatgtaacaggcgggcaacgaaagaaaccgttgttccctgcactaccagtgaaacgattgtgatgaagaatacgacattaaagataatattcgatccttcgactcctgcaaccaccggataagtggcgaagataatgggaactgctccacgcaatcctacccaggagacgaacagccgcgatttcattgtaatcttccggaacggaagcaaacagaggaacacacttaacgggcgaccgatcacaatcatgaagacaccgatcaatagtgctactgctgcaacttccagcatttcatgaggattaacgagaagtccgaggcagaggaacatgatgatctggaacaaccaggtaagtccgtccatgaacgtataaatgtctttgcggtgcatgatcttgttgtttcctaccatgatacctgcgatatatacggcaaggtaaccatttcctttcagtaaatcagtgatagagaaggtgaagaaaacaaacgccagcaacaagataggatacaacgcctgattgtcgatgttgagcttgttcagcatacggatagccagttttccgagcacgtatccggcagccgcgccgactataaactgaatgatgaaagaagcggcgatagccccgactcccatacctgccgattggataaactgtatcaggacaatggtgagcatgtatgccatcgggtcgttacttccactttccagctccagcatggggcggaggttgtgtttcagattcatcttctgcgaacgcaggatggcgaacaccgaagccgagtccgtagaggacatggtagatgccagtagcaatgacgtggtgataggcagatagatattcgtccagctcattccggacagccaccagataaataatccggtgaaaagagcggttagtagaactccgacggtagaaagcacgatacctggacctaaaatgggtttgatttctctgaatttcgtatccatacctcccgaaaacaggatgatgcttaaagcaaccataccgatgaattgcgcatcttttgcgtcatgaaactggagtccgagtccgtcacttccgaacaacattcctactacgaggaacagtaataaggtgggcactccgaagcgatatcctgtttttccgacaacgatgctaacgaaaagtaagatagaaccaattagtagggtgttttctgctgtaaatatcataggcaatatattattaagttattaaatgtgtcgtaataggtctcaccgtgcgaagttacacattatttaaaacaaataaagagtctttttggatgtatttttgtgaaaaaaggtagttaaattgtctaaaaagattaattttgcactcaattaatctacatcatacttatggattcaaacaatcttactcctttacggaaaggagtggtaggagtacaattcttgtttgtagctttcggagctacggtactcgtgccgctcttagtggggcttgacccttccaccgccttgttcacagcaggcattggtacactcatttttcatgcggttacccgagggaaagtgcctatctttttaggaagtagttttgcgtttattgccccgataataaaagcgacagaactttacggattgccgggtactttatccggaatggtgggtgtcgcattggtttattttgtaatgagcgcgttggtcaaatggcaaggggtgagggtgattgaacgtctgtttcctccggtggttattgggccggttattattctgatcggtttgtcactcgcggggacaggagtaaatatggcgaaggagaactgggtgctggccttgttgtcgctggttacggcagtcgttgtctcgatgaaagcgaaaggacttttgaagttgattcctatcttttgcggtatcattgtcggttatctggcggcatggcttttctatgatctggatttgtccggtgtgagggatgcggcatggatcgggctgccgcagttcgtgtttcccaagttctcatgggagccgatactgtttatgattccggtagctattgctccggtgatagagcatatcggagatgtatacgtagtcaatacagttacaggaaaagacttcgtgaaagatcccggtctgcatcgtacgttgttgggcgatgggctggcttgctgctttgccggattggtcggcggtcctccggtgacgacttattcggaggtgacgggtgcgatgtcattaacgaaaatcaccaatccgcaagtcatccggattgctgccatatccgctatcttattctccgttgtcggtaaaatcagtgcgttgctgaaatccattccgagtgcggtattggggggaattatgcttttgctgttcggaaccatcgcttgtgccggaataggtaatctggtaaataactgtattgatctgagccgtacaagaaacatcatcattgtctctctgacattgactgtcggcattggcggagctgttctcacgtggggagacttttcattatccggcatcggactggccgctttggtcggagtacttcttaatttgatattaccgaaggacgattgactctgttcttgaaatggtcaggactgtgtcaaggttaatagtaactaaactaggaccgacttttaatcagccccagtttagttactattgacacccctcctttttatatttaatagttaaggcttagcatgtatatacgtcttgtgtttatgacaagaacttcataatatcttcgtctgcggtactgatgccaccgattccgaattgttcgatcaatacgttttttacgtttggtgaaaggaaggccggaagagtaggtcccagatgaatattcttcactcccagtgccagcaatgccagcaatacgatcaccgctttctgttcgtaccatgcgatgttatatacgataggaagtttgttgacgtcgtccaatccgaatacttctttcagtttcagtgcgatgacagccagtgagtaactgtcgttacattgccctgcatccaatacgcggggaatgccgttaatgtcccctaaagccagtttgttgtatctgtatttagcgcaaccggcagtcagtatgactgtatctttcggaagtttctcggcaaattcggtataatattcacgacttttcatacgtccgtcacatcctgccataacgaagaacttgcggatcgctccgcttttcacggcttctactaccttatccgccaaagccactacctgtgcatgggcaaaacctccgatcaacgttccgctttcgatggccgtcggcggttgacattgcttggcatgtgcaatcagtgcggagaaatctttcggttttccgtctttgcgttcggggatgtagtgtgctccctccagtccgcaggctccggtgatgtagatacggtctttgtaagaagcgttggcacgcggaggaacgatgcagttactggtaaacaggatcggtccgttgaaactttcaaactcttctttctgtttccaccaggcatttccgtagtttcctgccagatgcttgtattttttcagttgggggtaataatgtgcggggagcatttcactgtgagtgtaaatgtctatacctgttccttcggtctgttccagcaattcttcgaggtctttcagatcatggccgctgataaggataccgggattattgcggacacctagattcacttccgatatttccggatttccgtagctgtttgtattggcggcatccagttgtgccatggcggaaactccgtgcttgcctgttgccaaagtaagctgaaccaattcttccatcgtaatatcattgcgggtgagctcggccagtgcactttgcataaaggcgaagatttccggtgactggtatccaaggttatgcgcatgctcaacgtaagccgccatacctttcagtccgtagtgtaccagttctttcagcgaacggatatcttcgtcgggtgtgcgaagtactcctactgtcctggctttctcttcaaactcatcttcattcccatcccaaagacattcgtcgggagcatttgcaatggttactttgctggcgagttcgtttttcagttgtagtccttcttttatttttctgatgatggccgctttgtcaaaattggcgttagtgatggtgatgaacagggcatcgtagataaatttgtctgcttcttcagaaggatgtccttcccggcgcagatgttcgttgtacacggcgattcctcgtactacaaagagcagcaggtcttgcaggttagccacttcggatgtttttccgcatactccttttaaggtacagcctgtacccattgcggtctcttgacattgataacagaacatactcataacttttacgttttaattagtcttatttgattatgaacgcaaaagtaggggaaaagtttgaggtaagtttgtaaccaatgttacattgggcgaaaaaaatcggatgctatgagctaaattaaattagctataatcatattccgattagctataatgaaaaaaagattagctataatgaaaccggagtgaactcttggtcattgaatcagccggatcagccattctttctgtaagatagtaatctgtttccggtcggctatgatcataccgtcttcctgcatgtgcgacagttcacgtgccagagaaggacgggagacaccgaagtaatcgctcagttcctgttgcgagcggtcgagggtgatctgtagctgttgctgctgtttgtataaccgtagcagataagatgctatcttttgccggatagtcttgaaggacataaagaaaagcttatccgatagggtacgggcataattggcggatagattcatataattctccagaaactgctcgttcctacgaaaaagttccagtacgctggctttggggatttcgattacttccgtcggttcgttggcggtcacttctaccggaaagcgattctcttctccgaaaaggaaaagaggggcaagggcccttggtgcggcaatgtcttctactttgatgagtcttccggaatagtcaatcatttcgccacggacacttcctttggtcagtatcacgagacggttgcacacatctccctgtcgtgccagtatttctccttttctataagaacgggtgtggaaactgatctcttccagattggcggataacttctccggagtaatcccccggaataatgggttattggtgagtgcaggtgtcataggctggtctgttatttgaattttaatatgaatttcgtttccttgttgtccggtaacagcgtgaggcttccacccgaaagccgcatgatctgacgcgaaatacttagtccgattccgctgcctccttctttggtagtgaagaaagggataaaaatgtgctccactatttccggtggaatgacgggaccgttattcttaatctcaatcagcacttcttccgtttcgttgcaataaacctgaatgtcgatttgtccgtccggctgatcaccgattgcctgaatcgcatttttcagaagatttatgactacttgcgaaatcagattttcatctgcatgcaggatcaggtcggcaggatcgatctttgtatggaacgtgatgtggtcacaaggattctgatggcgggcaagttccaccattcgttcgatgaatgctttcaagtaaaacaatgaaggttccggagtcggtatccgtgtgaatttgcggtaggattctacgaaagcaagcagcccttttcccgtggcactgatggtttgcagtccgtggctgatctcttcgtctttgtcctccaccatcgagagaagcgtatcgctgagcgaagtgatgggagtcacggagttcatgatctcatgagtcagtactcgggtcaggcgaatccatgaatctatctccttttcgtccagctcaatattaatatcattcagtgcaaggatgcgcagatgttctttgtgtacattgatttctgacacgcgaatagacagattgaccgttccccgttcattgtgaaacaccacttgcagcttatctccggaacaacaactttctatcttctccatcagtgtagcatctactttactcaactggcggacatgggtaaatacattcagtcccaaaagccggagtgcttctttatttttctgatagaccgctccgttatcattgagcaccagcagtcccgtgctgacaaagtcaagaatcagttcgtagtacttttcctgttgggcagtctccgcttttacattatataaaatgtggcccacccgattgagtgcccgattgatctgtttactctcgggagtaccggactcttcggggaaacggaaggcactgtcattattctccaacgcatcgatcatgaagagcacctgcttgatgtgcaggcgataaagccggacttgccagatgatacttaagatcagcagacaggcactgacgctgaaccagacataagactgatgcacgcccaaacagatagtcgccagacagcaaatgaccgtcagtgataccctgaaccaatattggttggctacttgttgtagaatccggttcataatccgaattttttcatcttgttatagagagtctgtcgggtaattcccagttgcgcagctactgccgaaagatttcctgcacaagcatccagcgctttccgtatcatttgtacttccatctcttccaaggtggaaatattcttctcggaagtttctgtctttcgggaggataactggaacaattccgcagggatttgcaccccgtcgttaatgatgaccaccttttcgattgcgtgctccaattcgcggatattgccgtaccagggatgcgcggtaagcttttcctttgctgccggactgaatttcatcggttccttatcatattgcttgcagaagcggatgataaatctttcggcaagagggacaatatcttctttccgttctctcaaaggagggatttctatatgaatggtgttgatacggtagagtaagtcttcccgaaactcttcccggtctaccatttcctgcaaattccggttggtggcgcatatcagacggatgtcaataggaatcggagtgttacttcccactcgcacgatacttcttcgttggatagccgtcaatagtttggcttgcaggtgataggggaggtttcctatttcatccagaaacaatgtgctgtgatcggcagcctcaaactttcctgtccggtcggtatgcgcatcggtaaaagggcctttcacatgcccgaagagttcgctttcaaataaagattcggtgattgctcccatgtccacagcaatcatttcctgttgcctgcggttggaaagagcgtgaatttcacgggcaagcatttcttttcctgttccgttttcaccggtaatcaggatattggcgtctgtggaggctaccttttcgatcagtgttcggagttgttgcatagacttgctttctccccaatagagtgccggagtgttgaccggttcctttttgtttcctgtcttacgtccttgctgtgcggatgaggcggcagcctgtagtgtttctaccagtttctgattattccagggcttgacgataaagtccgaagcaccttctttgattccccggatagcgagatcaatatccgcataagcagtaaaaagtacgacaggaagctcccgtcgtactttctttatttcgtgcagccagaacaatccttcattgccggtattgatgcccgaagtgaaattcatatctaatagtaccacttccggtgtttcctctcgtatcgcagtggtcagtgtgaccggtgacgacagtgtgacgactttcgaaaagtagttttttaaaaggatttgtaccgctgtcagcacccctttattatcgtctacaatgatgatggttcctgatttactcatgtccgaattggtttgtacgctacaaacttacgaaaaagtaattcataattcaaaattcggatttgaatttatagccattggaactttaatccgaatgataaactcagataatcacggggacggaggtagctatttgttacaccactgatcagataaagatcgcatgtacttatctcgtagaagaaagtcacggactttgccagaaatcggcggttagggtcaatatcataggtcagccgttgtcccatgaaaacatggatacgcaccttgcttgaaaaaccatagtatcctttcggataacgttccggttcgctgacccagaactgattgccgaatacggtattcagatatagtccgcaggaaagcggctcggtagagaatcctttccccaggttgatgctccagggcatatagttctgtttcagtgtcatggtcacttttgccttcttggacgaatacttcgggataaatccgagcaacaggtcagtttcccactgatttcgttttccgtaatcccatccggtaccgaaggagagtaatcccatatttccggcatattgtattttagagtgggtcggaatgatgcgttcccagtttttgcggaagcgatgtacacgtctgtcgtagccggtgcgaagaaccggttcggcaatataaggaagtactgtgtctgctttgactattgtgaatgcagaatcaccctcatgaaaggctatgatagaatctgccttaattgccagtttcagcgagtcgggtttatagttcctgataattgtatctggcttgcaagtagccgaaagcaggctggggaagagtagaagcatagtcagtactcctgcgcggatcatatatttagtattcaaccagttcatattcgtatttttccggggttatagtaaataccagataactgcgacttttcatgcagtcgctgacaatataatgcacatcgtcatcaaaaaggattctgtcatcgaatccgtgattatgggcggccgtgcagaactgtagtcccggatattgggtgatgtagtactggaacggcttcgccacattatcattgaacacatctgcaaaaggatgtgcatgcatgctgactacggttttttcaaactcatctgccctgtccgtcagttcctgttccataaaaccgaaattgggaataggctccgaataatcatattccagcgcattggtattaaggcagacgaatttcacattgcccgcaatgaatgagaagttggtaggtccgaaaacagcctgataagtttctgctccggtacccagacagtcatgattcccgataaggacgacataaggcactttcagtccgttcatgatgtcccgctgccaaagaaactctttggtcagcccgaagtcactcatatctcctccgtgaatgacgaaatcgatatcatctctcttattgacctcttttacaaagtcttctgtctcatcataccatcgctgcgaatcgcccatcgtgataaaacggatggttgtctttcctttgcacttagcttctatttgttcaatgttatgagcatttacgtctgtctctccactgatacgtacatcgtaggggtggtagtctatcagatcgcatccggccagaagcaggcagaccaggagagtgtataaattcttgtttaccataaatagaataatttatttaattgaaaacttgatgcgaagatagagttttcagttgagatatgggcgattgcttgggcaaaataagaaaaatggaacaataaataggcattaatgcatactttccactgagaaaggaaatacgattgtctttgtctaataattagacgcatgtgtctaattattagacagtagatgataggacagataactataaatgattgagaatgagtattctcactattgtggcacgttatctgcactgcatcataaaaaaacaggaatatattatataatcatgagacaaatctattatgtcattcgaactttgctgcgggggcgtagttccaatgttgtcaaggtcatttctttagggcttgggctgacaatgagtattttattatttgcccgcgtggcttttgagcagagctttgataaatgttttaaggattatgaaaacttatatcaagtcttttccatctttacgatgaatggcgaacaactcgaaccgcaagatcaaaattgcggaccggtagcgggtgcaattcttgaaaactttcccaaagaagtggaggcggctaccagttactgcctttgggtgaatgatcctctctatcatggtagtgtccgttttgaagtcagaaagctggcggcagattccctctttttccagacgatgggaatcgaggtcttaagcggaactccggtgaaagatttagcccaaaaagatgtagtttacctgagtgaccgtttggcacgaaagatgttcgacacagagaatccgataggcaaggttatctcatacagtaaagagatagaacttacggtaaaaggcacctatgctgatataccggagaatgcgacggtaaggcctgaagcggtgatttctctgccgtcgatatggagccgcaaatggggaaattactcatggagaggtggtgacagctggctggcgttcatccgttttcgtcccggagccgataagtcggtagtgaatgcccggatagacgcaatgatacagaagtatcgtcctgcggaagatcaaaaagtggttggatataccgcttttgtaaaaccaatccgtgacgtatatcgtgataataaagatgtaaggcggatgcggaacatcatgactattctgggtattactattcttttcatcgcttcattgaattatgtgttgatttctgtttcatcactttcctatcgggcgaaagcggtcggtgtgcataaatgcaatggggcaggaaacatgaccatattgagtatgtttctttgggaaacagcgattatcattctgtttgccctgatcctgatgggattgatcttattgaattttcaggatttctttgaagatacggcagctgtcaagttaagcgctttgttcagcttggatcgtatttgggtacctttattaacggtggctgtacttttcgttgtgggtggggtattgccgggacgactgtttgcaaggatacccgttactcaggtattccgccgatacacagaaggtaaaaagggctggaaacgaccgttgctgtttatccagtttgccggtgtagcatttatttgcggactgatgtatgtggtgatgatgcaatattattatatcttgaataaagatttgggttataatccaaagcgtgtagtggtggccaatgccagcttcggtgaggaagaaaaaggaaattatgccttgaatgttttccggaatatgccttatgtggaatccgtgtccagtgccacttatcatcctgtctacggatatagtggaacgattattaatgatgaaagcggacagtcactattttcatcccgttactgcagtgttccggatgattatccgaagatgatggggatggttctgaaggagggacgtatgccccgtggtgacgatgagacagtcgtcaatgagacttttgccgagtggatgcattggggaaacaatatactgaatcgtacagtttataattcgggatacgtatgtaaggtagtgggcgtgatgaaagattatcgcatcggaagttttaccagcccgcaacaaccgttgctgcttatgcacaccaagaggtttggtgattgtatccatgtccggttgaaagaaccttttgccgagaatcttctcaaactgaataaggagatggagagtgcatttcctgataagactatcgaatttcggtcgatgcaacagatgatcaaagagaattataactctgttcgtgttttcagtaatgctacgatgctggcggcaataacaatgttttttgtgatgttgatgggattgataggctacactacggatgaggtccgccgtcgttccaaggagatagccatacacaaggtgaatggttctgaagcaaccggaatcttggaactgctggtgaaagatgtgctttatgtagccgttgttgcagttttaatcggagtggtagcagcatggtacgtcaatggtatgtggatggatttgtttgccgaacatgttccgctcagttgggctgcctatcttctgatagcaattgcaaatctggcagtcattgtagcatgtgtactttggaaatcatggaagattgccaatgaaaacccggtcaatagtataaagagcgaataaagaagaaataaaaagtataacaacataataaatgaacaagatgatacagattgaaaacattagtaaagtattccgtactaccgaagtagagacagtcgcattaaatcacgtgaaccttgaagtaaaggaaggagagtttgttgccattatgggaccttcgggctgtggcaagtccaccttactgaatattcttggtttattggataacccaaccgaaggttcttaccgattattgggagaagaagttgccggactgaaagaaaaggaacgtaccggcgtccgcaaaggcaaactgggctttgtatttcagagttttaacctgatagacgaactgaatgtctttgagaatgtagaacttccgctgacctatcttggtatcaaatcttccgaacgccgccgcatggtagaagacatcttgaaaaggatgaatatcagccaccgtgccaaacacttcccgcaacaactttccggcggtcagcaacaacgtgtggcaattgcccgtgcggtagtgactaatccaaagcttatccttgccgatgagcctaccggtaatctggactccaagaatggcgcggaagtaatgaacctgctgacagaactgaacaaggagggaaccaccattatcatggtaacacactcacagcacgatgcgagtttcgcacatcgtaccgtacatctgtttgacggtagtgtagtggcaagtgtaacggcataaaccggaacgacaatgagacaaatctattatagcatccgaaccttactgcgcgaacgcggcacaaatatcatcaggataatttctctttcgctgggacttactattggtattttactcttttcgcagattgcgtttgaattgagttatgaacattgttatccggaaccggaacgactggctattgcacgttgcctgaccactaaccttagcacgggggagacaatgggagacgacggcaacaattatgattacacactttttgatgtggttgcatctactttggcgcaggatatgcccgaagaaatagagtttgccagttgtgtcctcaccggacaagggatgagtatatattacgaagacaaattattatcggatgttaactatatatacgctgatacttgtttcttccagacttttggtatccctgtcttaaaagggaacccgaaagatatgatcatgccgggaagtgtgtttgtgtcagagcattttgcccgtgaaacgtttggagatgcggaccctatcggtaaaattcttaaagcagacaggcaaaatgattttactattcgtggtgtatacaaggatatgccggagaatacggtgctcactcacgactttgttgtctccatccatcgggatggaggatatcagggaggatatggctggaagggaaatgatgtcttttacacgtttcttcgcctgcgtaatgctgcggatattgacaaggtgaatgacaacatccaacgggtaatcgaaaaatacactcctgcccagtatgatgactggaaaatgaatttcagtgtcatcccattggtgaagtatcatttgatatcttccgatgtgcagaagcgtttgatcatatatggctttctgggattcgctatcttctttgtggccatcatgaattatatgctgatatctattgccaccctaagccgtcgtgccaaaggagtaggagtacataaatgcagtggtgccagttccggaaatatcttcggcatgtttttggcagaaacaggaatccttgttatcttttccgtacttcttagtcttctgctgatagtcaacgcacatgaaataatcgaagatttgctttctgtccgtctatcctcactttttgcgtgggagacactatgggtgcctttgcttacgattgtgatacttttccttttggcaggtggcataccgggacggctgttttcgcgtataccagtcacgcaggtgttccgtcgttactctgatggtaaaacgggttggaaacgttcgttgttgtttatacagttcacaggtgtctcctttgttttggggctgttgctggtaacgctcctgcaatacaaccatctgatgagccgcgatatgggaataaacgttccgggactggttcaggcaggaacctggttgccgaaagaaacggtagagcatgtcaccgatgaactgcgtcgccagcctacggtagagggagtggctgttgccacaagcggagtaatcggacagtactggacacgcggactgatgagtaatgacggtaaaagaatcgctacacttaactttaattattgcagttataactatcccgaagtaatgggaataaagattatcgaaggcagcactcttaagaaacaggacgatttattggtgaatgaagagttggtacgtctgatgaaatggacagatggggcggtaggaaagaaactgaatgatatacagggtacgattgtcggtgtcttccgggatgtccgcaactatagcttcttttcaactcaggcacctattgtcttgataggatcggagaatgccaatcatgtatttgatgtccgtttgaaagagccgtatgatgaaaatctgaaacgtctgaacgagtttgccgataagacatttccgaatgtagccttgcatttcagttctgtagacggtatgataaaggatatatacaagagtgtatatcgtttccgtaattcagtctggatcacttcaagctttattctgctgattgtaataatgggattgatcggatatgtgaatgatgaaacgcaacgtcgaagcaaagaaatagccatccggaaagtgaatggagccgaagcctctcatattttgcgtctgttgatacgcgagattctgtatgtctccgcttcctccatattgattggtaccattgtttcctatttcgttggaaaggcatggcttgaccagtttgccgaacagatttatatgaacccgttattgtttgtgggtacggcgctgtttgtcttattgctgatcgtagtttgcgttgtgttgaaagcgtggcacatcgccaatgagaatccggtgaaaagtataaagagcgaataagaatattattatcttttaggcacggattaacgcggcttttatgagatgcattcattgcagaagccatattaatccgtgtattcgtgcctaaatatttttcatactgatatatcttttagcatagcgtcctttttgctttattccgccactttatccgctatcggatgttctttcgatactttctttatataaatcatcagactgataactgccgtaataaatgctaaagagtccgataccggcagactgatccatattcccttcagtccccaccaatgcgggaataacaacaggcaaggcagcaaataaagcaactgccgcgtcaacgaaaggaaaatacttatttttactttgcctatactttggaagaagttaccgattacaatctgtgctcctacaaacgggaacataagtacagtcaaccgaagaccgtccaccgcaagtccgattaactcatcactatccgtgaagactgccgatactgcatgagggaaaaactcgcaaatcagaaagccactgcttgtaatcactacaccggaaataattcccagctttagcgtctgtttcacccggtctatcttctgtgctccgaagttgtagcctacaatcggctgcatgcccatcgtcagtcccagtacgatcatgacataaagtgttagcaaccggttgatgattccgtaagcaccgatagccatgtcgcctccgtgttcctgcaaactattattaatcacgataacgatggcacaagcacagacattcatcagaaaaggagacatgccgatagcgaaaatactctctacaatccttcctttcattttccagacctttccctcaaaatgcaccgtactgtctttcttgcagaagtggctcaccacccataccattccgatcagctgtgagatgaccgttgctgtagccgctccccgcattccccattcaaagtgaaagataaagataggagcgaggatgatatttgctactaccgttaccatagaagtaagcatcgctttcttcggatatccggtggcacgcatcacattattcaggccgatcatcgtgtatgtgatgggagttcccaataaaatcacctgcataaaactccgtgcataaggcagtgtgtcgggactggcaccaaagaaagtcagtatatcatcaagaaagataaaagacaggataccgaaaaagaaagaatttgtgatacagagcatcagcgtatgtgacagaatctccgtagcccctttcatatctttctgtcccaggcgaatagaagcgatggtagaaccacccgccgaaacgagtgtacagaaagcaacgaccagattcatcaaaggaaagctcaccgccagtccggcaatagccatcgcacccacaccgtgaccgatgaagatgctgtcgatgatattatagatagacgtgattgtcatcccgatgatagcgggaaggagtattgcaacagtagcttaccgatgctttcttttcctaatatgtgcggatcgtttttgctcatgcgctcgtatggattgttggatgaaaacgaatgttacgtttttttaagtggggcaaaggtacgaattatttgcctgattcgatgattattcggaactttgcacaattcaatacacaaggtttaacgttttaggtaaaaagaaagattacgtatggatacaacaaagacaattgcggcactgttcgattttgatggtgtcatcatggatacggaaacacagtacactgttttctgggatgaacaaggacgtaaatatctgaatgaagaagacttcggccgtcgcatcaagggacagacgctgacccagatttacgagaaatatttctcggacctccccgaagctcaacaagagattacggccggactcaatatttatgagaaaagcatgtcctatgagtacatccccggtgtagaagcttttattgccgatcttcgtaaacacggagcaaaaatagccgttgtaaccagctccaacgaagagaagatgcaaaacgtctataacgcccatcccgaatttaaaggaatggtagaccgcatcctgaccggagaaatgtttgcccgttctaaacccgctcccgactgtttcctgctcggtatggaaatattcggtgctactcccgaaaactcgtacgtgttcgaagactccttccacggtctgcaagccggaatgacttccggtgccactgttatcggtcttgccactaccaatacaagagaggccatcaccggaaaagcacattatataatagatgacttttcggaaatgacctttgaacacttattggccttgcaccgttagttctttcttattatcttcttaatttgtctttttggccgccttctcattaacttggggaggtgtttgaaaggattttttctttttctttctcacttatgaaagaaatgttataactttgccgcaatttttgatggcgttgacgccttatttaatttctagttttaatttaaaatttaagaaacatggctggttatatatcagatgacacaagaaaggtgactactcatcgcctggttgaaatgaagcaaagaggcgaaagaatatctatgcttacttcttatgattacacaatggcacagatcgtagatggtgcgggaatggacgtaattttggtaggcgactccgcttcgaacgtgatggcgggtaatgtgactacattgcctattactctcgatcagatgatttatcacgctaaatcagtagtacgtggcgtaaaacgcgctatggtcgtagtagacatgcctttcggttcctatcaaggtaacgaaatggaaggtcttgcttctgccatccgcattatgaaggaaagccatgccgatgctttgaaactggaaggcggagaagaaatcatcgatacggtgaagcgtatcatcagtgcgggtattccggtgatgggacacttgggactgatgcctcagtctattaataaatacggtacttacacggtacgtgccaaagatgacaacgaagctgaaaagctgattcgtgatgctcatcttctcgaagaggcaggctgctttgccatcgtactcgaaaagataccggctactcttgcagaacgtgtggcttccgaactgacgatacctattataggtattggtgccggtggtcatgttgacggacaagtattggtcattcaggatatgcttggaatgaacaacggattccgtccgcgcttcttacgtcgttatgcagacctgtatacggtgatgactgacgctatcagccgttacgtatccgacgtgaagaattgcgacttccctaacgagaaggaacaatattaaaacagtatatggcagttaaattgtggacagttcattttatgcggatatgcgtagctaatttgctgttgtttatctccttgtatatcttgtttccggtactttccgttgagatggcagaccgtctcggagtaccggtggcacagacaggagtgatctttctttttttcactttaggaatgttccttatcggtccgttccatgcttatctcgtagatgcttataagcgtaagtacgtatgtatgttctcttttgccacgatggtggcagcaacggcaggatacgcctttgtgacgaacatcacggaacttatcttgttgagcaccgtacagggactggctttcggaatcgctaccaccgcaggaatcacacttgccattgacataacgaacgctacacttcgcagtgccggaaatgtcagtttctcctggatggcacgtctggggatgattataggcattgttctgggtgtctggctttatcagagctattcctttaaaaatctattgtccgtatcggtgattaccggagcagcaggtgttttgatggtatccggagtgtatgtgcctttccgtgcaccgattgtgaccaggctttattcattcgatcgctttttgctgttgcggggatgggtgcctgccatcaatatgattctgatcaccttcgttccggggttgttgattccgcttgtacaccgtttccttaacgattccgtatggggaagcagtggaatccctataccgttctttgtcggtacgggcatcggatatcttgcctccctgctgctggcgcgtctgtttattctgaaagaaaaaactttgcggctggtgctcgtcggcatcatactggagattgtagccatcactctactggcctccggctttccggtaggcgtaccttccatactcttgggtttgggactggggttggtgatgccggaatttctggtcatgttcgtgaaactgtcacatcattgtcagcggggtacggcaaataccactcatctgttggccagcgaagtcggattcgcatccggaatagctgttgcgtgttacttcgatttggaagcggataagatgctctatacaggacaggtggtagctgtgattgctttgattttctttatactggttacatatccatattataagagaaagaaagtgagataaatcgtttcgcactatttccgtgacatgattgtctatcataaataaaaagactggcgttatcctgacggagataatgccagtctttttattaaagacctgtcaacagatttgctgttagcatagagtgcttagtttctgcttacctgtttaactcccttcactgtccgcagctttttgatcagcgcttccagtcgtccggtatcacccaccatgaccgtaagcgttccggagaatagtccgtcgttggaattgattccgatggaccgcagactgattccattctctttggaaatgatggaagtaatattggtaacaatgccgatatcatcatgacctactacgcgcagcgtaatcggatactgcgtaccgactgacttgccagcccaacgcgctttaacaatccggtatccgaaccgttcgcgcatctgattggcattcggacagtctgcccggtgaatcttgatacctccgctcacggttacaaatccgaatacatcatccccatagatcgggttacagcatttggccagtttaaattccagtcctttcagattctgatcaatgactagtacatcctcttttgaactaggttcttcctgagttgcctgcaaattatatccttcggcactgcgatacacaatctcatcgtgcgtgtcattgtcccgtctctgctgttcaaggtatttgtccagaatgtcgttgacatccaatgtctcgtcagcaatcttctgataaaactctgtcacatttttaaagcccagccgcttgatcaggcgcatcatggtggcttcgtcatactccatcttccggttcttgaacttccgttccagtgtctctttggcgaaatcgtgctggcgtgctaccatctctttgagtgcctgccgtatcttggtgcgggctttggaagtcgtcacgatgttgagccagtcctgtttgggagtctgggtattcgacgtcatgatttctacctgatcaccgctgttcagtttctgtttgagctgtacatttttgccgtttactttcgcaccgatacacttgcatcccagtttgctatggatgtggaatgcgaaatcgagcacagtagctcctttggcaagtttgaataagtctcctttaggcgtgaatacaaatacctcatcctcgtagaggtccattttgaactgatccatcactttcagtgagtcgttatccgcattttcaagcgcttcacgtaccgaagtcagccattcgtccagtcctgtttcccctttgatacctttgtatctccagtgtgcggcgagtccccgttcagcgatctcgtccatccggcgggtacggatctgtacttccacccatcttccttccgggcccatcacggtaatgtgcaacgattcataaccgttgctctttggaatcgagagccagtcccgcagacgtttcgggttcggctgatacatatccgttacgatagaatagacctgccagcattcctgcttttctttggccgggtccggttcggaatccagaatgatacggatagcgaacaagtcatagataccttcaaacggagtcttctgcttctgaatcttattccagatggaatggatggatttggtacgtcccttgatgtcgaacttcagtccggcttcctttaccttcttctggataggatcgatgaaagaagcgatatacttgtcgcgggatgctttcgtctcgttgagcttctcctttataaagtagtaggtttcccgctgcgtatatttcagcgacaagtcttccaattccgatttcagcttgtaaagtcccagtttgtgggccagcggagcatataggtaagcagcttcgttcgctactttcacccggtcttcctcgttgcctgtatccttgatttggcgcatgatgttcacacggtctgcgatcataatcaggatgacgcgcatatcttcggcaaaagagagcaggagattgcggaaattctccgattctatcgccggacttttggagtacagttcgtttgttttcaccagtcctttgatgatactgcctacatcttcgccatattcggcattcacttcttcgatagacaggatatgtgccttcactatttcgtgaagcatgatgccgatcaggcacgaacctttcatgccgatttcttcggctacgataaccgccgtttgtaaatctctgatgacgggattcatcccgaagttattgcgttgcagcccgttacactgggcggctttgataagatgtttctttaatttttggcaatccctccagaaaatcgtatctccggcagattgcaacagatgcctgtagagtgaaaaaagctccttcttttcctctgatgtaaaaaagtcgtccatattcaatcttgttaattcgacgtaaaattagtttttttcccggttattcggcaagaagtaaataacattttgtatttttgggcatcaattaataaaaatagatattatgataacgacacaggacaaagagttgcttgccaagaaaggcatcacggaggcgcagatagcagaacagctggcttgcttccagacgggttttccttatttgaaattggatgctgccgcttccatagaaaaaggcatattggctcctgacgcagaagaaaagaacgcatatctggctgcatgggatgcttataagaatacggataaaatcatcgtgaagtttgttcctgcttcgggcgctgccagtcgtatgttcaagaatctgttcgagtttctgtccgcagagtatgacaaacctactacaaagtttgagcaggcattcttcgacggaatcagggattttgctttcttcgacgacttgaatgtagcttgtcagcgtacagccggaaaagatattccggggctgatggaagaaggtaattacaaagctgtagtagctgcccttctcgaaactgccggactcaactacggagcacttccgaaaggtctgcttaaattccataaatatcccgaaggttcacgtactccactggaagaacatcttgccgaaggtgctatgtatgcagccggaaagagtggaaaagtcaacgtacacttcaccgtctctaccgaacaccgtgaactcttcaagaagctggtggaagagaaagccgaagcattcggcaaacgttacggagtagactattacatcaccttctccgaacagaaaccgaataccgataccatcgctgccgatatggacaaccaaccgttccgcgacaacggcaaactcctgttccgtccgggtggtcacggtgcactgatcgagaacctgaacgatctcgacgccgacattatcttcatcaagaatatcgacaacgtagtacccgataaactgaaagccgacaccgttacttataaaaaactgattgccggcgtacttgtgtccttgcagaaaaaggcatttgaatacctcgaactgctcgacagcggaaagtatacgcacgagcaaatcatggaaattctccaattcctgcaaaaacaacttttctgcaagaatcccgaaacgaagaacctcgaagatgccgaactggtgatctacctgaagaacaaactgaaccgtccgatgcgtgtatgcggtatggtgaagaatgtaggtgagccgggtggcggtccgttccttgcttataacagtgacggaactatctccctgcaaatcctcgaaagctctcagattgacatgaacgatcctgccaaaaaggaaatgttcgaaaagggtacgcacttcaatccggtagacttggtttgtgccgtacgcgattataaaggtcacaagttcgacctggtgaaatatgtagataaagcgaccggcttcatttcttataaatcaaagaacggaaaagacctgaaagcgcttgaacttcccggcttatggaatggtgcgatgagcgactggaacacagtattcgtagaagttcctcttaccactttcaatccggtgaaaacggtgaacgacctgttgcgcgagcagcatcagtaggatttaaaacaagattggatccggtctgtcattcttcctcctccgcggtcgtccgaatggcagatacagacaaatgtctctcccaatcattataattactaattaagtaaaagcaaaatctgagaggctgactaaaagtcagtagtatcttaagatactgccgacttttagtcagctctagtgtagatagaaccgactttttagtcactacttataataaaaagagtatttaggatgaatcagatagaaaagatcattgacattgcaacatggaacagaaaagagcattttgaacatttcagcgcattcgatgatccctttttcggagtgacagtccatgtagactgtacccgttcttatcaggaggctaaagataaaggcgtctccttttctcttttactattacatcgtatcatcactgccgcaagcaaagtcgaggaattccgctaccgcatcgagggcgacaaggtagtctgctatgacagtcttcttcccgaagcgacagtagggcgtgccgatcatactttttcttttgccgcctttgagtacgatcccgatgagctcacctttatccgtaaggcgaaaaccgaaatggagcggctgcaagccaccaccggactgaacaaaggaggaactttccatcccaacgccattcactattcggctgtcccatggctggcctttacagatatgaaacatcctacgaacatgcgttcgggtgatagcgtccccaaaatatctaccggaaaatactttcgggaaggagagaagctgatgctccctatttccgtcacttgtcatcacggactgatggatggttatcatgttgccaagtttattgagacccttgatttatgaaaccgtcaggaactgaagactaacaatgacggcactatgagaaacaagaccctgagatggaaaaccatcgctctttgttccatcatgttttgcctgccggagattcctttggcagggcaggagtcttctggttttatccatcgtttggggatagaagcccgtccgcagtatgtgtttcctaccaatcccttcctgcaaggagagaacgaacgctggaaaccgattcagacatcgtttgccgcccacttgaaatactcgttcaagtttcgtcccaatacttgtgccgaccgtgtttacggtggagcttatcagggtatcggtgtatcccttaccacctttggtgataaaaaacagttgggcgatcctttctcattctatgtatttcagggagcgcggattgcccgtttctctccccgtgtctcgctcaattatgagtggaatttcggtctgtccgccggatggaagccatacgacaattattataattcctataatggtgcggtcggctcacggatgaatgcttatatcaatgccggagtttacataaactgggcgttttctcgatacttcgatctgattgtcggaggcgatttcacgcacttctccaatggtaacactaaattcccgaatgccggaatcaatactgccggagccaagatcggactcgtctacaatttcaatcgtacggaagaagacctctcgaaatcactctaccagcctgtcatcacccgttttccccggcatatcagttatgatgtcgtgctgttcgggtcatggcgtcggaagggagtgtgggtaggagagaagcagatcgcatctcccaatgcgtatcccgttgccggattcaattttaccccgatgtataatctgggttataagtttcgcgtgggagcttcactggacggtgtctatgatggcagtgccaatgtatatagggaagatgtaattgtagaatatggaagcagcagttctaaacgtgagttcctgaaaccgggcattcagcatcagctggccttgggactttcgggacgtgcggaatatgtgatgccttattttaccattggcgtcggtatgggagccaacgtgctcagccgtggcgatatgagaggcttttaccagattcttgcattgaaaatagccgttacccgcagttcctttcttcacatcggatacaatttgcagaacttccagacgcccaactatctgatgctcggactcggtttccgtttccacaataaatatcctaaggtacgtcattaataaaaagaaatatactaattttgcatcactaacataaaacactcaaaataatgaagaaaatattgttactcggttccggagagttaggaaaagagtttgtgatctctgcacagcgcaaggggcaacacgtcattgcttgtgattcttatgccggagcacctgctatgcaagttgccgatgaatttgaagtcttcgacatgctggacggtgaagcattggaacgcgttgtcgaaaaacatcatccggacatcatcgttccggagatagaagccatccgcacagagcgtctctatgactttgaaaaagaaggaatccaggtagtgcccagtgcccgtgccgtcaacttcacgatgaaccgtaaggcgatccgtgaccttgccgccaaagaactcggcttgaaaacagccaactatttttatgccaagaccctggacgaactgaaggaagcagccgccaaaatcggtttcccttgtgtcgtcaaaccgttgatgtcttcttccggcaaaggacagtctctcgtcaagagtgccgacgagcttgaacatgcctgggaatacggatgcagtggcagccgtggcgatatccgcgaactgatcatcgaagaattcatcaaattcgacagtgaaatcaccctgctcaccgttacacagaaaaacggacctacgctgttctgtcctcctatcggacacgtacagaaaggcggtgactaccgtgagagtttccagcctgcacacatcgaccctgcacacttgaaagaagccgaagaaatggcggaaaaagtaacccgtgccttgactggtgccggactttggggagtggaattcttcctgagccatgaaaacggagtctacttctccgagctttctccccgtccgcacgatacgggcatggtgacattggcaggaacacagaatctgaatgagtttgaacttcacctgcgggccgtactcggtctgcccatccccggcatcaagcaggagcggatcggtgcaagtgccgttatcctttctccgatagcgagtcaggaacgtcctcagtatcgtggcatggaagaagtgacgaaagaagaagacacttatctgcgcatcttcggcaagccgtttacccgcgtcaaccgtcgcatgggagtcgtactttgctatgcaccgctgaactccgatctggatgcgttgcgtgataaagcgaaacgaatcgccgagaaagtagaggtgtactaaataaaaaagaatgagagtgagtcaaaagcaaaaggatagtgaatattgcttttgattctctctcatcatctcctcttatataactcataatgaaaaacatgaaaaagactaaactattggcagctactgctatgctattactgacttcctgttcacctaaagtggtcactcatattgtaagaacctatccgaatcccgttccggcagattcggtttatgtcatcgaaccgggagatacagttccaaacacagccgaaacgctcggaagtgtttctgttgtagaccggggtacatccagaaattgtcgttatgatcaagtgctgcgcctggcacaagaagccaccgggaagaacggtggaaacggactcgccattaccgaacatgtgaaaccttctttctggggaagttcctgccatcaaatcaacgctttaatgcttcgcctgacggacacaaaggtgaatgcgactgaaggaaaccctgtacaagacatgattgaccttggccgggtggctgtgaaagaagaaaaggaagagcggagagcacctgccaacacgttcgaagcgagcttcgggtatggttgggtgaccagcaaaatgtatgatatcaacggtgcgactttagactccaaaggaggaatcgattggaagctcgcttacgaatatacgtggagcaatggtatgggaatcggattgcaatattccggtttcagaaagtctttctccgatggaggagacatgaccttctcttatatagctcccgagtgggtaggtcgctcgaagttcgacagatggattttaaagtcgggactcgggatgggcgttttcctttatcatgatcccctctacagtgctaccggatttggttttcatgccacggtgggagtggaatatatgctttccgccaattggggactcggcttgactctgaacggaattagcggtagcctgcccaaacaagactggatgctgctgaaagaagacgagcgttgtggaatcacccgctttaacctgttgggtgggttgcgctattacttctgatgataactccttctttctaggaagaatatcaatgtttatactgtacttagatttataaataaagagagagggcagaagtctgaaactgcatcctctctctcgcgtttataacattgttatttctttgatcttacagactcatcgcattaccgcctacaatacccagcactgccgaagccaccgcgatgactactttcaaaatggtatcccaaagggatctcttgactgccataactttacacacctcctttccgactctttacatgattgattactaagtgaatcattaccgaatgaatgattgcaaggcataactttcctcctttacctcaaagcacgggcacgccttgatccactcctccggctcaatctctccattaccgttgcgatccggcgacaagtcgcgatgaccgcacacccggcaaccggggaatctctcttgcaactgatgcaccagcagccggagcgctgcccgctgttccggtgtccgtgtgtccgccgggcgtccccggcagtccaggccgccttcgtagcaaattccgatactctccgcattaaaacctttcgcatgtgccccgatccgttccaccggacgggtaagatgcgttgttccatctttgcggatatagtaatgataacctgtcccgttaaatccccgccggcggtgcatcgtatccagatcaaaagccgtcaactccttgtctgcccgcgttgcagaacagtgaatcacaattaaatgaatcttcctcataaagccactaattctaactatcaatccctcgtacattgattaccaactctcaactctccacttcttacactgtcgggtccggagcttcctcgtcgcctccgccgccttcgtttccaccgccaccgggggtgttgtcctctcctgatccgtcgcctttcttctttttcggggcttcgaggtcgagaaactcgatcttgtcaccggcacgggtagacgttaggttggggcggacgctgctggaagggcggaagttgatctgtatagatttgatattcttcaccgtacactcttctttcgtggttgctcccagcgtatgggcggataggctgaatacaccgaagtctctgatattgaccgattttccgtcgaagagcgccgctcgcattgcctccacatagttggtcagtacgctttggatgtcgcccagggagagggaactcttgtctttcatgatgtaggcgatgccgtcaaggtctacactttggcccatcgtcaccagttgggggtggtacttcagcaccccgtcaatttttcgcgggtctttacgacccattcttttaaatggtattgccatgatgataaattaaagatttagaaaaatataaattaataattactgattgctgtcactcgatcagtgtcgggagagagaatgagctctgtttctttctttcgatgtgtcaaaggtagcctattattaagccatgagaatacgtactttatcgtacttcgtcgtactttctttcagaatgtatttactttctttctgattgattttattttacttgtttgcttgtgtgcgcaaatatgttttagtatatttgaagtacgaaagaacttaaaaacaacgatatgaaaacagaaaaagaagaagcggaagaagaaccgtttgtcatccgtccgtatttgaagtcggagctggctcacaagtacaatccacatttgccattgatttatgccatgcagaaactacggggatggatcagaaataataaagaactttatgacgctatgtatagcggtggagaaggaaaaaacgatcatgcttatagcagcagacaggtgaggctgatcgtgaagtttctcgatgagccgtgaatctgtttttcgatgagtcgtgaatctgtttcttgataagtcgtccgtctgtaaggaagaaacaaattagctattagcatatcgaaattagctattagctaatttgtttttgctaatagctaatttcgatatgctaataagacttattgtttttttcttgtgacaatgaagtaaaagtcacgaatttcccctttcaaagtccagtaaagtccagaaagtccatattagattttcagaatatacgaaccgtgacctaacttgctgattctccctgctttaatgcctttattcaataagtagtaaacggtgcttcttgagaggttcaattcctctcccaaagcacatgcttctttggctgaaaaactctttttgagtttcgtcagaagtcgcgagagattatcgggcgattgtaatggtttcgtatcttcggcagagctttttaccgaagtactgaccagtttactatgttcgaagcaacacagcacgatggcgagcgctgctttgaaatgcgcgtccgagcagtatacttcgggtgtttccattctcatggttcccttgtcgatggcggagaaaatgcagcagatgcgtgccgttatcactccataacgtttcaccacccccagcaggtcatcattacctaactggtccgtatctttgagcagttgcgtgaatacccggttgaattcttttttctgtgtatctgtcagctttacttccgtaggagaatctttcagaaacaatgccatctgtgcgaagcgcatggacaactcgttgaagagatcgtccgcccgcaccttttcctccgcgaacacatcctgccatgctgccggaagtctgaaggtattgatcagaaagcggttgtacagccctgtctccatggtcgggatgaataaaatgaggctggatggagtgccggtgagaaaagccgacagggagggatattccactttcagcggatgtcgtccgttgatcttgtaggacgaactgatcagttcgtgctcgaatgccttgcagaggatatcgtcgaagtgtccgtaatcttggttgcgggctgtgctgacgctgctggcttcggtactggtgagcaaggaagaacaactttggttgttgatgaggtgagtgatgagctgtgcacggctgatgtcggcagggatcagcggaaatgccagcttcggctcctccggttcgtccggcaggttggtggcagcagtattctttttgcgtatcgcctgcaaggagagggtgtagtccctgagtgctttcttgtattccttttcgatcttcagactctgcttctcccaatactcacaatagtgcttgtgcaggcgtatgccatagccgatgaggttcttgttggcaccggaggaagctacgacgatacagtagatattgggctgataattccgtcggttgtagcggatgcttacactggggagcatgctgcttatcgtggtaatacatgacaacaagagtccgtccctttcacgctcatctcttgcgatggagacgcactccttgaagatggcgggaatgagatcgtaaatttcgtcaggaaaggtcggagtctgctctctgagctcttctccgatgatttcatcctccttttctgccggattttcgttttctgaaaatcctataacggacttttggactttactggaatttgaaggaggattttcgaagctttccgtctctgccgcagtcattacattctggtaagctgattttacagtacgtgcgatttcgggctcacggaagttgtcttcttccaaggtgcgaaccaattcggtggtcagttcgttacggtcgatgccgcgtttgcaggcagcgcagctgagccggaaaacggttccgttccggtcgcccgttgcggcagggtagagggtgaggtaggactgtacgaagggagcggcggaaatccggttatccggcatcgcaggcggatgtccgttggagaaagaggtgggagtgcaggtggtacggggagcggaagtgacgggagcgtaggtgacgcgcagagtgagtgcaccgttcggcagaaagtcgttgacggcctttgcgtcaccgttgtagtatgcgtccgggtcgtatgatccgaagcagggatgggtgatatccttgcatttcccgtcgttctctacgccgagaacggtggaaacgagctttgccgtcgcttcataaatggcaggataatcgtttactccatcgatatctatacgaatgaacaacttaacaccacgtccggagatgctgataaacgctcccagtacgtattcgagcaggcaggcacgtacgaaaatatcctttgtctgttcgtccgtatggtcgatgtcgatgcagagtgcgagtgacagggaggtaaggttgttttttgcgtgtccattcttgcatatgcctgcggggatgacacatgccatgctgtctttgatggtttgcgcgtcgtgtttgcggtcttttgccagacagctgcggtggccttccgtaggcactttccaatgtccgttgcgtaccattgcgaaaaaatcttcaaaagttatagtcgtgggagttttactccaagtgttgataaatagtgacacttggtacatgtgctttctcatttgaaatataatatataagttgccggaagcgggtggtgtagttatcacgggcttccggctgcgaaggtaggaacttctctttttttaccaaatcgattattaggactgatttctgttccaatcgtcccattggtctttcaccatctcctccagttttcccagacagcttttataggctatggcatgcttcggagagcgttcgtcgcggatttcgatgcaatggaacagccctttcagtacatccggacagcgtggcatcagcggtatctgcttgatgatccgttcttctttgttgcactctttgatgtctttatcctgtacggatttccaaagaaactgttgcttgaaaatctcttttgcaaggatttcaagtaattcattttgagtaaataagatggggaatccgggtaggtgacattgagatatatcatctactgtcaacggattgcctgctttgtctaccattgttacgtttaacgtaaagttgccgattttttcggcaaaagccaaaaggttttttttaccataatttttaggattaataatgcagcaaatttcttctttttttatcagaagagtgttttttgcttcttattttttctgctgacatttaacaaagtggcaaaattaaggaatttataattttcttgccgaaaacttttccgcttcaggcaaatggggagtgtttaataggatgtacgtgcccggatataaaactagttgcatatgctactattttatcgctcgtttaagtgtttgaatattaccgttgaatgggaaaacttgatgttaagtcatagttttaatgatattttataattaacaggcttgttttactatacaatcgtaattggaatgttccgatattggtctgtttgtagtctttgttggcctaacaagtgttattgaacgacaaataatgaaaaaggaagaacaacgatgctaatttgtttctacatttgcgcggttgtttatttaactattttgttaaaaagaaatcgggcatgattgaacaaaagctaaatttaactgtttactatagtagattaaagtagataaaacgcgaaacgttccttgtcatgctactaaaattcgataggtaaagaaagaataatataaataaagattgcttatgtcacagattatcggacatatctcacaggtgatcggccctgtggtcgacgtgtactttgaaggtacggacgcagagttaatgctgccaagcattcacgacgcactggagataaagaggccaaacggcaaaatactggttgtagaagttcagcaacacatcggcgagaatacggttcgtaccgtggctatggacagcactgacggacttcagcgaggcatgaaggtgtatcccaccggaggcccgatcacaatgccgataggcgaacagattaaaggacgactgatgaacgtagtgggcgactctatcgacggtatgaagagtctcgaccgtacaggcgcatattccatccaccgtgatcccccaaagtttgaagatttgacaactgtgcaggaggtactcttcacgggtatcaaagtaatcgacctgctggagccgtatgccaaaggtggcaagatcggactctttggcggtgccggtgtaggaaagaccgtacttattcaggaactgatcaataatattgccaagaaacataacggattctccgtatttgccggagtcggcgagcgtacccgtgaaggtaacgacttgctgcgtgaaatgatcgagtcgggcgttatccgctacggcgaggctttcaaggaaagtatggagaagggcgactgggacctttcgaaagtagactataatgaactggaaaagtcgcaggtatccttgattttcggacagatgaacgagcctccgggcgcacgtgcctctgtggcattgtccggactgacggtagcggaatctttccgtgatgccggcaaggaaggtgagaaacgtgatatcctgttttttatcgataacattttccgtttcacgcaggcgggttcggaagtctcggctctgctgggacgtatgccttctgccgttggttatcagccgacacttgccacggaaatgggtgcgatgcaggaacgtatcacttccacccggaaaggttctatcacctccgtacaggcagtatatgtgcctgcggatgacttgacggaccctgctccggcaacaaccttcagccatctggatgcaacgaccgtgctcgaccgtaagattacggaattgggtatctatccggctgtcgatccactggcttctacgtcccgtatccttgacccgcacatcgtgggacaggaacattatgacgtagcacagcgcgtgaaacagattttgcagcgcaacaaggaattgcaggacatcatctccatccttggtatggaggaactttcggaagaagataaactggtcgtgaaccgtgcgcgccgtgtgcagcgtttcctttcgcagccgtttgccgttgccgaacagtttacaggcgttccgggcgtgatggtaggcatcgaggatacaatcaaagggttcagaatgattctcgacggtgaggtagacaacctccccgaacaggctttcctgaacgtgggcacgattgaagaagcgatagagaaaggcaagaaattgctggaacaagcgaaaaagtaatcgaaacaacattccatgatgaaagaattgcatttaagtatcgtatcgcccgaaaagagcgtattcgacggagaagtgaagattgtcacactgccgggaacggtaggatcgttttctatcctgccgggacacgcgccgatcgtctcgtcattgaaagcgggaacgttgggttataccacgatggacggtgaggagcatacattggatattcagggtggttttgttgaaatgagtgacgggacagcttcggtgtgtgtctcgtaaggaagacgagatggataatatacagcagaaaaacacaacgacatggtgaacattagtaagactaaacggaattttatcgcactgaatacgctgtttgctatactaagcggagcagcgggagcagtgattttacacatagccttgccggggcattatttcggaggatatccgtttataccggtatatttctatatcttcggtttgtttagtatttatatgttcgatgcgtgtcggcggcatgctccgcagaagttgtcgctgctgtatctggcaatgaagatgataaaaatgattctctcgctgattctgctgctgatttattgtctggcagtacgcgaagaagccaaggctttcttgctgacgtttatctcgttctatctgttgtatctgatatatgaaacgtggttcttcttctcctttgaagtgaacctgaaacggaaaaagaaaaataagaataaaaatgaaacagttgcgtaacatagtagctccgatatttctgctctgcctgatgttggtagccggtctgccggtcttcgcgcagacacaggaagatgtgactccgcaggagcagaaagagaatacggtcgatgtgaaggagatcgtgttcgggcatatcggcgactcatacgaatggcatattacgacgtggggtaaaacgcacattactataccattacctatcattgtttatagttctactacaggttggcatacgttcctttcttcccgtctcgctgagaatggaggcacttatgaagggttctccgtcgcccccgaaggaagtaagtacgaaggcaaactggtggagtataatgcagccggagagcaggttcgtccgtgggatatttccattacgaaggtgacattcgctttgttgttcaacagtgtgctgctgctggttatcgtgctgagtgtggcgcaatggtacaggaagcgtccgcagggagcgttggcaccgggtggttttatcggattcatggaaatgtttatcatgatggtgaacgatgatatcatcaagagttgtgtcggacccaactaccggaagtttgcaccgtacctgctgactgcgtttttcttcattttcattaataacatcatggggctgattcctttcttccccggtggtgcgaatgtgacgggaaacattgccattactatggtgcttgctatctgtacgttccttgcagtcaacatctttggaacgaaacattactggaaagatattttttggccggatgtgccctggtggctgaaagtgcctgtaccgatgatgcctttcatcgagttcttcggaatctttacgaaaccgtttgccttgatgatccgtcttttcgccaatatgctggcgggacacatggcgatgctggtactgacttgcctgatctttatctcggcaagcatgggacctgcgctcaacggtacactgacggtagcttccgtactgttcaacatttttatgaatgcgcttgaactgttggtagctttcatccaggcatatgtattcaccatgctttcggccgtatttatcggactggcgcaggaaggtgcaaaagtaaaagcagaataaacgcgaagagagagcaaataaataaacgagaaaataaaccattttaaaactgaaaattatgttactatcagtattgttacaagccactgcagcagcagtaggagtaagtaaattaggtgcagctatcggtgcaggtcttgcagtaatcggagctggtttgggtattggtaagattggtggttcggctatggaagctattgcacgccagccggaagcctcgggtgacatccgtatgaatatgattatcgccgccgccttgatcgaaggtgtggctctgttggcggtagtagtatgtctgctggtattcttcctgtaatattaaatagatatgtcattactattacctgatagtggcctgttgttctggatgtttgtcgcattcggggttgtgttcgtgatattagcgaaatacggtttccccatcatcatcaagatggtggaaggccgtaaaacctatatcgaccagtccttggaggtggcaagagaagccaacgcccagttagctcatttgaaggaagagggcgaggcgcttgtggctgctgccaacaaggaacaaggacgaatcttgaaggaggcaatggaagaacgtgacaagattgttcacgaggcccgtaagcaagcagagatagccgcacagaaagaactggatgcggtgaaacaacaaatccagatagagaaggatgaagcgatccgcgacatccgtcgccaggtagctgtgctttctgtcgatatcgccgagaaggtgctccgcaagaaccttcaggacaaagaatcccagatgggaatgatcgaccgtatgctggatgaagtattaacccctaataagaactaaggaagatggaagtcggagtactctcaatgcgatatgccaaagcgatgatcgaatacgctcaggagaaaggtgtggaggatagactctacaacgaattcttcacattgtctcacagttttcgtgtccagccgggactgcgcgaagtgcttgataatcctgtggtgtcggtaaaggacaagttggcgctgatatgtacggctgccgatggtaacggtgaatccagcagagagtttgtccgtttcatcacgctggttctgcgaaacaggcgcgaaggctatttgcagttcatcagcctgatgtatctcgatctttaccggaaactgaaacacatcggagtaggcaaactgattacggcagtcccggtggacaaggagacagaaaaccggatccgttccgcagcagcacatattctgcatgcccaaatggaactggatactgtgatcgatccctcgatagaggggggcttcatcttcgatatcaatgattatcggctcgatgcaagcattgccacgcagttgaaacgagtgaaacaacagtttattgataagaataggagaattgtataatgtctgaaaatataagagtaagcgaagtatccgatatattgcgcaagcagctcgaaggtattaacaccaacgtgcagctcgacgagatcggtacggtgctccaggtaagcgacggagtggtacgtatctacggattgcggaacgccgaagccaacgaattgctggagtttgacaacggcatcaaagccattgtgatgaacctcgaagaggacaacgtaggtgccgttctgctgggacctaccgacagaatcaaggaaggctttatagtgaaacgtaccaagcgtatcgcctcaatccgtgtaggtgaaagcatgctgggacgtgtcatcgacccgctgggcgaaccgctcgacggaaaagggctgatcggtggagaactgtatgaaatgccgttggaacgcaaagcgccgggagttatctaccgccagccggtaaaccaaccgttacagacgggcttgaaagctgtagatgctatgattcctatcggacgcggacagcgtgagctgattatcggcgaccgtcagacaggaaaaacttccattgcgattgatacgattatcaatcagcgcaataactttctggcaggtgacccggtgtactgtatttatgtggctatcggtcagaaaggttctaccgtggcttctatcgtaaatacgctccgtgagtatggagcgatggattacacgattgtcgttgccgctacggcaggtgatccggcagcgttgcagtattatgcaccgtttgcaggagctgccatcggtgaatatttccgtgataccggccgtcatgcgctggtggtttatgatgacctttccaagcaggcagttgcttatcgggaagtatcattgattcttcgtcgtccgtccggacgtgaggcgtatccgggtgatatcttttacctgcactcacgtctgttggaacgtgcggcaaagatcatcaaggaagaagaagtggcacgcgaaatgaacgaccttccggagagcctgaaaggtatcgtgaaaggtggtggttcactcacggctctgcctatcattgagacgcaggcaggagacgtttcggcatatatcccgacgaacgtgatttctattaccgacggacagatattcctcgaaacggacttgtttaatcaaggtgtccgtccggctatcaatgtcggtatttctgtatcccgtgtaggtggtaacgctcagattaaggcgatgaagaaagtggccggaaccttgaagatggaccaggcacagtatcgtgaactggaagccttctccaagtttagcagtgatatggaccccattacggcgatgactatcgacaagggacgtaagaatgcacaattgctgattcagcctcagtatagtccgatgccggtagaacaacagattgctattctgtattgcggcacgcacggtctgctccacgatgttcccttggaaaacgtacaggattttgaacgcagcttcatcgaatctttacaactcaatcatcaggaagatgtgctggacgttctgagaaccggtgtgatagacgataacgtgaccaaggctatcgaagagactgccgctatggttgccaaacaatatttataaaatgaagacgctgtgtcaaaagtcaatagtaactgaactgggactgacttttgacacacactcattcttaattcttaatttaaatagttatggcttcactgaaagaagtaaaaaccagaataaattcggtaaagagtacccgaaaaatcacttcagcaatgaagatggtggcttctgccaagttacacaaggcacaaggagccattgaaaatatgctgccttacgaaaggaagcttaacaagattctgaccaacttcctgagtgccgaccttcctgttgaatctccttacatcaaggcgagggaagtgaagcgtgtggcaatcgttgccttttcttcgaatacgtcgctctgtggtgcttttaatgcaaatgtgattaagatgctgctgcaaacagtcggtgagtttcgtacactgggacaggataatatcctgatattcccggtagggaagaaggtggatgaagcagtgaagcgcctgggattcgaaccgcaggagacttcaccgacgctttccgacaaaccatcgtatcaggaggcttccgaactggcacatcgcctaatggaaatgtacgtatccggagaaatagaccgggtagaactgatctatcatcattttaaatcaatgggcgtgcagattctgcttcgcgaaacttatctgcctattgacctgacacgggtcgtggatgaggaagagaagcaaaaggaagaagaagtacaaggaggtgatatagcgaatgattacattatcgaaccttctgcagaggaactgatcgccaatctgatcccaacggtattgagccagaagctttttacggctgccgtggattcgaacgcttcggaacatgcggcacgcacattggcgatgcaggtggctacggacaatgcgaacgaattgatccaagatttgacgaagcaatataataagagtcgccagcaggctattaccaacgaattattggatatcgtgggtggttctatgcagtaaataaagattgcacgataacactattttgtgaatcggtattccgtttttaagctttgtccggctggtaattaaataatctatatatttgaaaattatttgagaggtgagattgttttgatgggaacaaaacaagccttgataactaacaaaacaaatatatagattatgacacaaaagcgattattcggcatttctggtgctattgctacggcagcattgattggtgggctgttggctggatgtatggaaaaagatctgtacgatcctaattatggaaaagaacctcttccggaccctagcgagtatttcggatttgaaacacgtggcgacgtgaaactctcagtaaactatgatgtccccggacttgtggctctacttgaagtgtatgatgaagacccgatggaagtagtggacaatgttccggtaaagaaagaaggggttgaagctttattcaaaatttttacggatggaaatggaaaatatgaagggaaaatgaatattccgacttctgtagagactgtttacttgtatacatcaagctggggagtgccccgatgcgtaaaactagatatcaaagatgggatggctagttttgatatgagtaaaaaggattcttctactgccaatactaaagcggtaacgcgttcttatgacttttcgaaaggtagcgtgccgtatcttatcaattccggtgctaatttgtattcattgtgtaagtggggagaaggaggaaatctcacctatatttataatagtcaaacaggaaagccagaccctattaataatggatatgtaacacctcaaaaacaagtgggtaatgaattgattggaaatcttgtagaacgtttaaactcttttttcaagccatccggaggttctgttgacaacgcttatttgtataagggatctgaaatcactaatattaatgtaacacaagagggaactacgttagatttggtctttcttgacagggacgcttcatttaataattcatttggatattattattataaaacaagtgatggagttagtaactctaatatgaggaagtatatcgtatttccaaatgttgctttttccgtatataatggagctttatctattttgaagtgtggagataaagtacgtctgctcttttggggtgaggatggtaaaccaagtgagaaatttccgaaaggatatacagtaggatggtttatatatgcagatgggtatcatcaaaatgagaatgaaattgacattacaaagccattaataacttctaatgggtattctaatggtggtttcgtatctgtaaaagatgaaaagagtggaaaaaccattattggtgtggaagatggagcaaacagaagtttttgtgatctactattttatgtagatgcttctccggaaagttctattgataatccgaacagacccaatatcccgagtgatgataaaccaatagaaaagccggatgcacaggagaacttaaaggggactttagcctttgaagatatttggcctgacgggggagattatgacatgaacgacgtgatcgtagaatataatcgtgccatatatttcaacacagaaaacatgataaataagattgtggatacatttacgcccacacacgacggagcgatgtatgataatgcatttgcttatcagatagatggaggacagtttggtaaagtgacttcagataaggatataaaagtggagagcgaaacgtcttctattattgtattcccaagtgtaaaacaagctgttaaggggaaagtgggtacgtgtacgataaccagaacctttgaaaaggccacttttaataaggagaatctgaagatatataatccgtacattatagtaaaatatgcggcagggcaacagaaccggacggaagtacatctgcctaaatattcaccgacatcttatgctgacaaatcgctgataggttctagtaaggatgtctattacattgatcgtgacggagcttatccgtttgccatcgatattccgatgttgaatttcattccggtgacggagacgcataacattgatacggaatatccttatttcaagaattgggctgattcttggggatcaaaatctacagattggtacaagagatatcagtcttccaagaattaagaaacaaaaacaatttcgatatataactgtgacacgactttgtgttctgatttgatccggtcccggtgtacttcaagcgagaagaaaccgggaccttttttgtttatttgtatacaaatatttcgggagtaaagaaatgatgatgaaaataccggcttgattattgcttttccttacattcaatttcggtggttggaatctattcagtacctttaccgaaaattagaggaaacatggaaaataatcctgaactacaactagcttggcagttcattgaaaatacaggcacgcatctgtttcttaccggaaaagccggaaccggaaaaactacatttctaaaacgattgagagaacatacccccaagcgcatggtcgtattggctccaacaggaatcgcagctatcaacgccggaggggtgacgattcattcattctttcagttgtcttttgctccgtttgtgccggaaacgactttcaattctgccaagatgcactaccgtttcagcaaagagaaacggaatattatccgcagcatggatctgcttgttatcgacgaaatcagtatggtacgtgcagatttgctggacgctgtggacgcggctttacgtcgttatcgtgaccgtgaaaaacctttcggaggtgtgcagttgctgatgatcggcgacttgcaacagttggctcctgtggtaaaagacaatgaatgggagctactgaagaatcattatgagactccatatttttttgccagccgtgcactgaaggaaacggtgtatatgaccattgaactaaagaaagtctaccgtcagagtgatactttctttctttctcttctgaacaagatacgcgaaaataaagcagatgatgaagtgttgaacgaattgaatcgtcgttatcagcccggttttcgtccacggaaagaagaagggtatatccgactgacaacgcataactatcaggcccagcaggtgaacgaccgtgaactggcatcactgtccggacgggcttatagttttcgggcggagatagagggaaattttcctgagtactcgtaccctgcggatgaagtgcttacagtcaaagaaggagcacagatcatgttccttaagaatgacgtttcatcagaaaaacgttactataacggcatgataggcgaagtgatgagtgttgacgaaaaaggaatgtccgtacgtggaaaagacagtagtgatgtctttcagttgttgcccgaagaatgggggaattataagtatgtgctgaacgaagaaacgaaggagatcacggaagaaatagaaggtgtgttccggcaatatcccatccgcctggcgtgggctatcacgattcataagagtcagggtctgacgtttgagcgggcgattatcgatgctcgtaactcttttgctcatgggcagacgtatgtagcattgagccgttgcaagactctggaaggaatggtgttggagactcctttgcgtagggaggcgataatcagcgatagcattgtagataatttcacaagagatgtggaacagaataaaccggggagcaagcagttgaatgacatgcaaaaggcttatttctatgatctgttgaatgatttatttaatttctattcgcttgagcaggcttataagcggttgctccggatgatggatgaagagctttataaactttatccgaagttgcttgccgagtataaagaactggctccgcatctcaaagagaaggtggtggaagtttccaatcgctttcgtaatcaatatacgcgtctgattaacgagaatgaaaattatgccggaaatgaggagctacagcaaaggattcattctggtgctgcttatttctgtgaagcattgcttcctgtccgggcgctgtttgacaagaccagtatgcctcttgataataaagagttgcggaaacaactgaatgaacgtttgcaggcattggacgatgctttatggattaaagagtctttgctggatgcgatgcggacggagaaatttacggtaacggattatctgaaacggaaggcgaaagtgatgttgagtctcgaaggggaaactgcttcttccggttcttccaccaaggctccgaaggagaaaaaagaacggaaagaacgcactcgcagcaattcaggaaaggtgaaagtagaagttccgacggatattctgcatccggaactttatcgtgctctgtcggaatggagaacggcaaagacgcgcgaagtgaatatgccggcttatgtgatcatgcagcaaaaggcattgatgggtattgtgaatctgttgccggatacaccggcggctttggaagcgataccttatttcggcgcaaaaggagtggagaagtacggacttgaaattttgggcattgtgcgcaaatatatgaaggagaacaaactggaacgaccggagatctttacttctgtttcggggaaagaggatacaagggaaagaaagctggatgcacagcataatgaggagaaagagaagaagaaagattcaaagctggtgagttatgaaatgttctgccaagggatgactatagaggagatagccaaaacccgtgatttggtgacaggaacgattgctgctcatctggaacattatctccgcgaagataaaataaaattggaacaggtagtgacagcggacaagattaagaaggtccggacttatctggaaacccatgagtttatgggagtggtggctattaaagctgcattgggagatgaagtttcttacgctgatattcgctttgtattggcgacggcggggcattaaaaaactcattttaataaaaaaataatgtccgaaaagctactgacagaatgataggtcagatatgcttttcggacattatggtatgatggggtacagagttataagttacagaagaaagaaacgaatacaggcacgctgatatcgatcagaataccatgcaaaatagcgataggaatcatttcttttcccgaatatctgctgatggaaggtaataatacatccattgagttgactcctgccgctgaaatgggagcaagtttcccgaaatacttcttgataagcggtgtacccaaaagtgccatcatttcgcgaaagatattagtcagcagggcaatggtacccagctctgtagccaactgtattccgatggtcggttccttgaactgagtgatcaggatggaagacagcgaataataggcgaatccgcttcctactgccatacagtcgaatacactccattgacttagcaaaatgcttgccaaggcagaaaacaacaatgtgccggtaatggtacccaatggaatcagcagcattttcgggtgcaaatgtgagatgatcgctttcaggttcttattggaaccgatgctgattcctacttgcagcatcaacgcatatagtatatacatggaaacagtatgtgtgtcgaactggaatttattaaaaactcccatgatacagcctacacagaaaaatacgataacgatgagacttcctttcattgtttacctcctttcttgaaaaatagttgtaacacaagccgggcagccaacaagctccctaatacgccggatacggcaagaatgatcgcctgccatccaaacttaccgagattattcacaatcaggctattagagccaatggatactccaaggataaagagtaacaggaatattgtaagagaaattgtcttttcagtcttttgtaagatactccagttacgtaatccgtatccgataccgattcccaaaaacatggtagatataatagagaacatattgtaatatattttagttggttaggttaaacaattcataaatagcatagataatccccaaaaagacatacatcttattgacaatcagatggaaatactgtctgtgagtaacgaaataagtcaacaggcagttaggggtaagaatgagtaaggggaatttagatgaatccgctgaaccaatgtacatgcacgcaacatgacgtgcagaaattgggaatttccgcatgaaatataagggcgttatgtaattgtaatgtttgattcatcttctggttctttaattcgggtgcaaagataagaacttattgcatattttcaaaataaatatgcaataattagaatgggaaaggtagctgaaactaggaatagaatgtagtaaaaacttggttatgtagaccttaacctttatatattatgtgtttatatcatttttatttagttgccagttcgatgcctgagtcaaatttctatgttgtgtagagcacatacttttatttgtgcaaacaatctgattaataggatttgtcggttaatgtttccactccatgaggatgtctttcagctttcgtggctggtaaccaagtatagtccgggcttttgctatactcatcccactgaaacggggacggggagtagcttcttgcatttcttctgttgtggcagggtgaacgagcgaacggtccagcttcatgtagtctgctacctgaaaagcaatttctgcgatggtcaggcattcctcgccacagatatgaaaaattccgtttgcggcattttctaccaggtgttgtactccggctgatacgtcacctacataggtgggcgtgcgccattgatctgatacgacacggatttcttgtcctgcattcaaacgattcatcaccagttgcacgatgtttccatgttgtcccggcaatgcttttccgtagacaatctctacgcgggcaatagcatagttactacagatttcagtcactttctcttctcctttccatttggtgaaaccgtaatagttgacgggagcagggagacttttttctgtataaagctgtccggacttctcgtctatctttccgtcaaagacgaagtctgtagataaatgaatgaaccggcttttgtaactttcgcaaagatgtgccaattgttctactgccgtaacatttgttagccaggcttcttcgtgatgcgtttcgcaataatcggggacggataaggcggaacagttgatgactacatcgggttgtacgtctttaaaaagttgctttacgactgcttcatcccgtatatctgtggtgatgaaatgatagttgcctccattcttcggaaggatatccggatgcagggaacatcctgttaccttatattgtgccttgctcgacaggtcattcagtatttggcgtccggtgaatccattggcaccgataattattatattcttcatgggctgttttatagtcgttcgtttcagtcatatgagtttttctcagtcacatgagtgagtttcggttcagaaatggcttttctatatttattttcacaaaagtagaaaataattttagttacgcaaatagatttcgtagttccctttttcttttgctcttttgcgaatttaagcatatcattatcaggtccgatgcgcatgccggatggattggatgaagtaccgggagcttacaaagatattgcgcaggtaattgctaatgagcgggatttagtgaaacctttggtggaattggcgcctatggcggtgatcaaaggataaaattagctgacgagatgaggtatggacataaaaaaaggagcaacgccttgctccaacctttgttaaccttaaatctaatactatgaaaaacacattgcaaagatacggacttctgcgaactttgcaaattatccaagaataatagtatgttttataacattgattaagaatttgaattctcaattctatttttattaagagatttcctgatcttatcttttgttcttaatgagtagctgcataccatgctgtttcttatttttttgaggccagcgagtgcgtacttggatcggagattgtaataccggagaaggtattgattttcacttctcctctgctcatcgaatagaaatattctgtatttcttttgaatggcaccgtacgattgagctgttcgttgaatcgtgccactagagtttcatcagggcataattttgaaacatagtcaccatagtcaaagaagataaccggataatatccgtccagtctctgtaaagaactggttagtgaaggatcaaaagtatatcgatgattaatttctttcataatagttgccaggttatcaagttctgagcaatcagtgacagcgattgttccgcagggtgtgctataagtggaataaaaagagtaaaaaccgtcacagataccggcataatctactttcccaattagatactgacctatctcggcgtatggcataccatacgccatcacttcacttgtagatcctatcagataatcagtcacatctttgagagcgtaggctacttcaatgcttgacatatagcagtcgtcaaagagtatatattccattttaagtccggcattggatattcctttggcaagtgtggttatatcagtctgatattgggcatttaatcctccgaagtagcgtgtcattggtacattttcgtattcccagtgcattttggtacgaagaccgctacgtgatttagaatttgatacgggtatccatcccatgccatgacagccgataaccatcgaatagcgtttggtgggagagtagcgttgcacatcatttaggatggatgtgataccttctgctgtggtatatgcaggatctgtatagttctttagagttttatgcacactcttgccattctcataagcgagttcaaaaagagtggctttcgttgctgtggtacacatgaaaatgattatccgttcatccttcaagatattcttttcaactacactttcaaggtcgctgatgttctgatagaaattggatgtgagattatcagaccaggggagatacatgaataccgtttgttctgtaggtaccggaactggctcttccttttcgcacgaagtcatgccaaaagaaaggaatagtacgatgataactgatttaatcaaatggtgatatttccgctctgtcttcattgttttgtcaggattaaagttacttcttgatatataacgtaaaaagagcactttttgatttatatattcagaatataatctgaatgtatccttttcaagtgttactgcaaatctactgaaaaataacgtaattctactatatacgaaagtccaatagctcacgtatggacataaaaaaaggagcaacgccttgctccaacctttgttaaccttaaatctaatactatgaaaaatacattgcaaagatacggacttctgtgaactttgcaaattatccaaggaaaatagtatgttttataacattgattaagaatttgaattctcaattctatttttattaagagaaaagtcagttaggcatcttgaaatcattcggcaaacaaccggtgatcttcttaaacaggcggctgaaatattgcggattccggaaaccgagttcctgcgctatctggctgagtgttttatctgtatttatcaaccactctttagctatctcgaaacgcttgaactgaaggtattctttgtacgacttccctgtttcatattccagcaaatcattgaaatatgcgggagaaagacgaagtactctgacgcactcctcaatagtgggaagatcggaggactgactttgtatagtattgaaatgatcatccaaaagacggtcaaaccgttcgataatctttttgttagcctcattgcgtgtgatgaactggcgttcgtagaagcgttcgcaataatcaagcagtagttcgatgtatttggaaatgatcttctgactatagcagtcgatgcagcgttgcaattcttcatttattttatccagaagttccagtatgacctgtttttcacgtaatgaaacatgcagtgcttcttcgggacgataagagaagaaagtatagtcacgaatgttcgctccaagcgcagtgccgcagatcaagtcgggatgaaacgccagtatccatcctttggaaggacgtgtgttgtcactatccttcatactgattgactcgccgggagtcagacagagaagtgtcccgtccgagaagtcgtagtactgatgtccgtatctgtaggcttcacatttgcattcgctcaacagaatcgtgtaaaatccgaatttgaaatccgtatgggaggataaatcggcttttgaaaggtcgatgacactgaccagagggtgcagtgtcttactccccatgcagcaattacattgatgcacacttcctatcttaagtactttatctcccatgacgtaactaatatcctgattaatggagctgttttagttctgttgcttatattcgtttggcgtacatccgacattcttcttgaacaatcggctgaaatgctgcggatactggaaccccagttcatacgcaatctggctgaccgtctggctaccttctaatatccgttccttggcaagttctatgatccggtgctggatatattcctgtgccgtttttcctgtttctttcttgatcaggtctccgaagtaattggaagaaaggcagactttgtccgcaaagtattttacagaaggaagtccttcggtaagtgcagtctgattctgaaaatactcgtccaataactgttcgaacttcacgatgatatctttattcgcctgattacgggtgatgaattgccgttcgtagaagcgcatgcaatagtcgagcaatagttctatattgcggacaatgagctgcttgctgtgtttgtcgatggcatgttccagttcgatttgtattttgtggatacagtcggtcacgatttccctttcctgttcggagagatgcagtgcttcattcacttcgtaagagaagaaactatagtgtttgatgttctgccctaaagaagttccccggattaaatcgggatgaaataaaaggccgatagattttgtacgaattggtgtctgcttgcggttatctatcccgataacctgtcccggagccatgcagacaacggttccttcctgatagtcataatacttccgtccatatctgagatcgccacattttgcgtctttcagaaacagagagtagaatccgatattcatacgatagtagtctaccgtctttgtcgctttcgagaagtcgatcacgtttaccagtgggtgcaaggtctctagtccgaacagttggtcatactggtcaatgctttcaatttttgttatttcttccatacggcttacagttttgatctgtcacaaagataaagcttttaaatgtatctttctcattccgtatttgcaaaacagtaatttgggtataagattcagtaatttgtatacaatgccggtgggtagtgggatgcaaactcacttttttcagctaaatatcagcgtgtcggaaacaaaaaaacgggataatcaagggatgtgaatagtagaattaatatatttgttcctgtgaatttaaaaagacttgttttatgaaagcattattcattggaggaaccggtacgatcagtaccgatgtagtagaattggctcaacagagagggtgggagataacactgctcaaccggggctcaaaaaaactgccggaaggtgtgggcagtatcattgccgacattcacgatgaggaagctgtggcgaaagctattgcagatgaaagttatgatgtcgtagctcagttcatcgcttacacggcagaagatgtagaacgtgatatccgtctgttccgtaataagacgaaacaatatatttttatcagcagtgcatccgcctaccaaaaaccgttggctgattaccgtattacggaaagtacccctttagtgaatccttactggcaatattcacggcataagattgccgccgaagaagtgttgatgacagcataccgtaccaccggtttcccgattacgattgtccgtcccagccatacgtataatggaacgaaacctcctgtaagcctgcatggaaataaggggaactggcagatacttaaacgtatccttgacgggaaaccggttattatccctggtgacggaagttccttgtggacactgacacattccaaagattttgccaaaggatatgtaggactgatggcgaaccctcatgccatcgggaatgccttccatatcaccacagatgagagtatgacttggaatcagatttatcaaaccattgccgatgcgctggggaaacctctgaacgcactccatgtggcttccgattttcttgcgagacatggcgggaactatgactttcggggcgaactgttgggggataaagccgcaacggtagtctttgataattcgaaaataaaacgccttgtgccggactttatctgtacaacttcgatggcggacggtttaagacagtcagtgcaatatatgctttcgcaccccgaaacacagactcctgatccggagttcgattcatggtgcgaccgtgtagccgacgcgatggctgcggcagacagagcttttgaagcagaataaacgttagttgagtaaataactcatcttgttattgatgattgaaatatcctattagcatatcctgattagctattagctaatcggattatgctaatagctaatcaggatatgctaatagccgaaacaagtcgatcataatgagtagcgtagttaataaagaccgttccgtccctgctgaacctcgatccggataccgaaattaccattggaggacttcagttcgaatgctccccggaaattattcttctcccaaggcatggcactacggttgggcactttccatccgtctttgtcatagtctccgtatgtattgattttccatccgtttttcagtttgaaggtgcccatctgcatgaactgcggtgaagacgacaatccccagccatacccatatccgaaaccggagaaaggggaagaaaatgcgtcggtgaatccctgtgtatagctggcgtctgtattcagacggaatatctgattatagtctttactcacatccggtacatcgagactgaatttcggaagtttgggaggggccacattcattaatcccatatcgagcaggaagccaccgaattcctttatattgctcgacggagcacgacgaatactatcggaaggaacctccgactgtgcggatgcaaaaccgaccgataatatcagcgaaagaaatagaatcagttttctcatcttcgtaaaggttgattgatgacaaagatagagatttttagtctgactgcctgcttccgttatgttttcttagagaaaaatcctttaaaaaggagtgtgctgctgtctcgtcgggatggtgtcactatcccactaagatagtgtaagtatcctgtggggatagtgacactatgccagtaggatagtgacactattttagagcttagtttgcaatgagtttatagccgattccccgcacattgacgatacgtatttgctcatcctgcgacaacttatgccgcagtttcgtgatgaatacatgcagactccgggaattgaagaaactgtcatccccccaaagttccagcagaacgtcctgcgtattgaccacctgattccggttttcacaaagccgtttcagtatttccgactcgcggtgggagagttcctgtctcactccggcatgcagcaatgtctgcgcgaccggatcgaacagataacttcctatctcaaaacggctggatacctttgtcttcgtgaagctgaacgcttttcccatcagcgccttgatacgtatgatcagttcctgcatgccgaaaggctttttcagataatcgtttgccccaagttcgaatccttctaccacatcgttgatggccgaacgggcagtcagaaacagtacaggtgtctgcttgtccgtctgccggatgcggcgtaccatttcgaatccgtccattttgggcatcatcacatcggccaccagcacgtccggccgaagttcaaagaaaagatgcaatccttcttcgccgtcggaggcggtatgtatggtaaaaccgttttcctcgagcgtatctttgataatcatggcgagtgtcagttcgtcttccaccaacaatactgtaatgtcgtttttgctcatggttctgatgttttagatagtaatggtaaatgtacttcctttgccggattcacttttgacggtgatggtgcctccatgtttttcgaccatgcttttgacatagaaaagccctaagccgtatcccttcacgttatgaagatttccggtcggaacgcgatagaatttgtcgaatatatgtttctgtttatccagagggatacctattccatgatcagagacggtgatagtcaccgtttctcccgtttggcggcactgaatcataatctctgcttcttgtttcgaatatttcacggcattgtctatcaggttactgatgatattgctgaaatgagtgcggtcggctactatcgtcagtgcttccggttctgtttccagtgttatgtgtacggggatatccgcttttagctggtgctgctctattaaagaagtaatcagttcttttagacaaatctcttcggggtgcagtctgaacgtcttgcggctttccatgctcatggaaagaatctgttcgacgagtccgctcaaacgctgtagctgctcttggctgatgcgcagatattggtcacgtttgcttttctcttccgcctggttgaaattcagcagcgcatcgttggcggcatacgccacggcaatcggagtctttaactcatgcgtgatgttgttcgtaaagttgctcttcatttcttccagcgtcttttgtttcagcagtgtccggatgaggaaccagaaggaaaatccgaggatgaggaagatgacaaatgaagtgaccaggatgccagtcatttgtttccataccagggaggtgatgggttccattatcagttggtagcgttgactgtgatgcctgttgaattcgtagttgtagcggatggctttcgggctggggatataggtgctgtctcctgcgatgcccagtgtatctatgaatgtctgggatgaatcctgagtagctccgctgtatatatataaggtacggtgaggcacatctatgttgtgtgctttcagtacatcggtcagtagactgtcatatttttgcaggttgatgtcgatgtaggtatccacgccggagtgcataccctgttggacgctgagtatgagttctttcatcgagtcctgtttctttaataatacatcaagtccgctttcgctggaggcaacggcgctggcatccggatcgttggcattgacggctagggtatctactgctgtttccgtgcgtgtatgcagggtgtctttgtaggtactgtccgtataagagacggtctggcttgtcaccagcgacttgccgtctgcaccatatccggcggaaacggtgaccgaaccatgttccacattatccttttgcagctcgttgacgcgaagcacgatttcattaaagtcgctcgtacgcatggcgtctttgatattattgttcatttcctgcttcatcgtgcggtaaagccctgtcagccaatatgtctggtaaacaaagatgcctgtcagcgagcagatgacaaggatgatgatatgtttcaacggtaatttcatacggacaaagatagtatgaaactattatctttcttctctttgataagactaaataacactagataagccggcgataacgtaaagtttcgttttttctcccgtattttgcagcatactcaaaaataaatacgatatgaaacgaacttatttactgcttttgttacttttcatgtattggatgtacgcttctgcacagcaggtacagacagcgcaggaacctgccgacagcgtaaaaaacgtagcctatatagacagcctgtatcgggaacttcccgaagtcatgatcaccggcgaacgtccggtagtaaaagccgaacaggggaaactggtatacgacgttccgagactggtcggcagcctgccggtagacaatgcctatgatgcagtaaagaacctgccgggagttgtctccatgaatgatgccctgacgttgggagggcagccggtcactgtggttatcaacggaaaagtgaccaccctctctgtagagcaattaagcaacctgctgaaatcaatgcccgtcagtcggattgaaaaggcggaagtgatgtattccgctccggcacgttatcaggtgcgcggaccgatgatcaatctgatactgacttcgggcatgggaaaagaaccttctcttcagggagaactatataccgcttacagccaattacactacgaatctctggcagagcgtgcgagccttctatactccggacgcaaattttctgctgatcttctctactcttactcttacagccgcgaacggagggagacagacaaggaagcgcttcacacgctcgccgacggttcggtgcatccgatgaatatgtatgatatcactacttcccgccacaacaatcaccagatacgccttgggatggactatgcctttaccgacaagcatttgctgagcttggtttataccactgctttcaccgatgtcaaaccttacgccacagtcaccggtgcgcagaactcggtcaccgattcgcactcggaaggacagctccataatgccaaactcgactatcagactcctttcggactgaaagccggagcggaatttacctattatcatgctcccggcagtcagctgctttacagcacactgggagaagaaacactgaacttcctgagcaaagataaccaacggatcaaccaatggcgtttctatgccggacaagaacatactttgggcgcagactggggattgaattatggtgttgcttatacgaccgcattggacaatagttatcaaatgtatttcgatcccgaaacggaaactttactgccggacaacaacatgcaatcccgtcgtcgcgagcagacgctgaacttttatgccggactcagcaagagtttcggtgagaaactttcggcggatgtctctctggctgccgagcaatatcatacggatatgtggaacgaatggagcctgtatccggttgccaacctgacttatttgcctgccccgggacatatcctgcaattttcattgagcagcgacaaggaatatccggaatactggagtatgcagaactccacttcctacatgggcgcttattccgagattcagggaaatcccttcctcaaaccggcaaccaactacgaagctaacattagctatatattaaaaggtaaatatgtgctgaccgcctattacagccgcacgaaaaacaaggaaatgcagacgctttaccagtctccggaacgtctggtcgagatctataaatgctttaacttcgacttctcggaacaggcgggcttggtaatggtagttccctttaaagtgaagaaatggctggactcccgcatcacggcaatcggcttccgttaccgtcagaaagacagtgatttctgggatatcccgttcgaccgcaaactatatacgtttgtattgaccatgaacaataccttcactctttccaccaaacctgatttgaagtttaccctaagcggattttatcagaacaaggcgatacaaggcattttcgaccttccccgttcgggaaatctggatgcggccctgcgctatactttcgcaaagggaaaagcacaactaaccttgaaatgtgatgacatatttaatacttccaccatttcgactaatgtccgtttcggacaacagaatgtgaagaatcactatatgaagactacccgtgccttcggtatttccttcaactacaaatttggaggatacaaggagaaaaagcgggaagaggtggatacttcccgctttaaataataagtattatctattttttgcatactcatccagtacgcgcttgatactttgtcctatttttacgtaatcggcttcgttcagattggcgagcgaaacacggacactccatttcggtccggcaaatccgccgccgttcagcaggacgagcgaagtctcgttggcaaggcggaaaacaacgtcgagcggattgtaggtcttttgcagatagtctacaaattcgtcaccgtagaatttcttcgcccataccagcatgtcgatttccgaatagtacccggcacgtagaggatcttctatcagcgtaaagccggtgttgtcccagagtgcatgcaggcgacggtggatgatttcctgcatctttgccttgtaccggtcttccttgtcgagaagggagaaggcggcgaacaggctcatctgcatttgctggggcagcgagagtcctgcggtatggttcagtgcaatctgtcggctgtcggccaccatgcggtcaataaacttcatcttctcaggatgtaaactgaggcttgcataacgcttgtttaagattgctgtttgctcctccgacaggcgggcaatcattttgtcgtagatgttgtcttcgtgtagggctatcactgcatttctccatcctgtggctccgaaatacttggagaaggaatagacgcagagtgtattatgcggcaactccgccatcaacgaacggaagtgaggtatgaatgttccgtacacatcgtccgtaatgatcatcagattcggattgtcattctttacgatgttgacaatacgtgcggcagtctccgggctcagcgcgtaactgggcggattgctcggattggtgatgaacaacgcttttatctgcggatttttcagtttatcgatatcttcatctttatattgccaggtgtgcagcccgtccggtgtcatctgatcggcagatatttcggtaacatcgaactgatagcggcgtaattccggaatctcgatgtaaggcgtgaagacaggaatcatcagggcgatggaatccccttgattcaacaggaagttttcctgcaatgaatcgaatacatagcacatggcagccgttccgccttcggtagcgaaaaggtcgaaagtgcctttgggcggacggcggtcgcacatttcctgtgccagataatcctgtacgatcagttcggtgaagtgcaggatacggtcggggacaggatactggtcgccgatgaccgattctgcccattcatgcaccagtctgtccggatcggctgcgtgctccatcagcatataattataggtttctttcagtaacctggctccggcttctttctcgttctctttgaggaaagcctcgaagcgggcggctattccttcctgttgtgggatgcctgctattccttcttccagggattggacacggcgacattcgcaaagtccgaattttcctaacaggaagaatgcttcacgcggttcggtcgcaatccagttcgggttgcctcgtcctgcgttcagcatggtatgggccattttcttgatactctcgtcagccatttcgatgagcttgtttttaagttcgaaagggctgatcgtttccatctttttggcaaagttcttggtgatagctgtgccagttgttttcttttccataatggtttttattattttgatacttaattttgatttcctatacattcactatactgacatttacatgagcaatacgatggctactccccagataatcagtagtgtattaccgactgcatacgtcacggtgtatcctaacgcgggagtgtcgcttcccagtgcgtcttgaatagctcccagtgcggcagttgtggtgcgtgccccggctgtacatcccagagtgagggcagggtggaacttgaacagatatcttcccatcagcagtccgctgagaagggggatggcggttgccagcgcaccgacgataaacaggctgaatcctacttccttgaaaccggtcacgaagctgggacctgcggcgatgccgacaacggcgataaacatattcagtcctacattattcaatacccataacgaaggttcggggataccgccaaaggtaggatgtttgctacgcagccagccgaatacgagtcctgcgatcaaggcacctccactggtggacaggctgatcgggatacctcccaggtgaatggcaagtgcgccgaccagaccaccgagcagaatacccagtcccacaaagatcatatctgtctggttggtggggcgatcgatatagcccatctgtttggcggcagtttctacttcgagttttgttccggtcagttcgaggatatcgccggagtcgatcactgtctgagcgagtaccggcacattgatgcctgcccgcttgatgctgcggatactgactccgtgcatgaatttcagtgcacggatcgtggagaccttttcgcctgcgaatgtgcggtgggtgaccattaccggaagcgtctctgccgggaagtcgagcagttgggcgtcgatcacttccggaccgatccagtcttcttcgccgattgcatattcacggcggccgcttaatacgacttcatcgcccggttgtagaagcatatccggggtgacttcttctatgacgcccttttgccgtacgcgttctacaaacagccgtttatcgttttccaccagatagttctccagttcgctgaccgtttttcctttgccgaaccattcgttgtctattttataagcacggaatacgacggggcggagggcggtgtaaaatccgggttcatctgcttcggaagttcccattttggcttccagctctttgcagtccgctttcaccttctccagtccgcccagcattttgggaccgagtgaagccagaatccatgcggaacctgccgtaccgaaaatataagtcacagcgtatgctacggggatagcattgataaatgtcgctttttgcgcatcgctgatgcttaattgattgatcgtgtcgcttgccacaccgatcactgcggagatggtctgtgaacctgccaacaatccggcagcttcgcctacatgatagcccatgattttggcaagtatccatggggcgatgaggctgacaatgcacatcaggacggcaaatcctacttgcggcaatccgtctttcttcaatccgcgaaagaattgcggacctaccttatagcccacagcgaataaaaacaggaggaaaaagacagctttcatcgggccgtctacactaatgtttaattgtcccaccagtactccgaccagtagcacgctggttactgttcccaacgaaaattttcctattttgaatctgcccagccagaagccggcgaataaagtgaggaaaatggcaagttcgggatgatcccttaattgattaataatccattccatatatgttgttcttgtttaggttatgttcttaacaacagttcttgtacaaaaagagtttaggggagtatgtgcgttatcgtcatagtttataaaaatataaattaattgtgcggaagttccgggcaaacgagagagcgtcttaaatttctcagtttcgcttttttgttatacttttgtcacttcaaataaaactaatcatattctgtatgaaatcagacatagaaatagctcgcagtgtcgagttgaaaaagatcaagcaagttgccgaaagcatcggaatccctcgtgaagaagtcgaaaattatggtcgctacatcgcgaagattcccgaacaactgatcgacgaggagaaagtgaagaaaagtaaccttgtcctggtaactgccatcacagcgacaaaggcgggtatcggcaaaactacagtatctatcggtctcgccctgggactgaacaaaatcggaaagaaggcgattgtcgctttgcgcgagccgtctctcggtccttgcttcggcatgaagggaggagcagcgggtgggggatatgcacaggtgcttccaatggagaagatcaatctgcattttacgggagacttccatgcgattacttccgcgcataacatgatttctgctttgcttgataattatctttatcagaatcaggcgaaaggtttcggattgaaagaaattctctggcgtcgggtgctcgacgtgaacgaccgttcgttacgcagcatcgtagtcggactcggacccaagtcgaacggcatcacgcaggagtcaggcttcgatattactccggcttcggaaattatggccattctctgcctttccaaagatgtggaagacttgcgccgtcgcattgaaaatattctgcttggttttacatatgatgaccagccctttacggtgaaagatctcggagtggcgggagctatcacggtattgctgaaagacgccatccatccgaatctggtgcagacgaccgaaggtaccgccgctttcgtacacggcggaccgtttgccaatatcgctcatggctgtaactctattcttgccaccaaactggcaatgtcattcggtgactatgtgatcacggaagccggattcggtgcagacctcggtgctgaaaagttctataacatcaaatgccgcaaaagcggactccagcccaaactgaccgtgattgtcgctacggcacaaggactgaagatgcacggtggtgtcagcctcgaccgcatcaaggaaccgaacatggaaggactgaaagaaggattgcgcaatctggataaacatattcgtaatcttcgctctttcggacagacggtagtagttgctttcaataagtttgccaccgacacggacgaggaaatggaaatgctgcgcgagcactgcgaacagttgggtgtaggttacgccatcaataatgcgttcagcgaaggtggtgaaggagcggtagatatggcccgtctcgtagtcgatacgatagaaaataatccgtccgaacctttgcgttatacgtataaagaagaagacagcatacagcagaagattgagaaagtggctaccaacctttatggagccagcgtcattacgtacagcagcatcgcccgcaaccgcattaagctgattgagaaaatgggaatcactcattatccggtttgtattgccaagacacaatactctttttctgccgatccgaagatttatggcgccgtgaataatttcgagttccatatcaaggatatagtgattaataacggtgccgaaatgattgtagcgattgcaggagaaatccttcgtatgccgggattgcccaaagaaccgcaagcgttgcatatcgacattgtagatggtgaaattgaaggactgagctgatttttactatttcatttagtatatttctgtactgtcaatcatccaatataaatccccgtctttccacttctgatagtttgggaagacggggatgattgtatatagagtccagtgtaccggtatgttgaccttgtctgatacactgtacgattgaagtcgctgctttccggaagagtatagtgcgtatttcaatttctctttttgtagtaagaaaacatcttttcgagcagatagtttgtctgattctgttaataaataaaaaagaaaagcctgttttcttcacagaaagcaggcttataaaattctaaagaaattctttatgaaatgttgaacacaaatgctgctaattcacattaccggcatttggttactcaaagaaagaaatcttaatcagcaaaaagaggatatttcttcattgtctcattgacacgtgcacgtacttgtgcgatcacctcttcattttccacgttagacagaactgtttcgatcatttcggcaatttcgatcatcaggtcttcttttgcaccacgggttgtgatggcaggagtacccagacggataccggaagtttggaaagcagaacggctgtcaaacggaaccatgttcttattcacggtaatgtcagcagaaactaatgctttttctgctaccttacctgtcagatcagggtatttgctacgcaggtcaaccagcatggagtgattgtccgtaccaccggaaacgattgtaaaaccacggtctatcaaggcctgtgccagtacggcagcattcttctgaacctgttttgcatattccttgtattccggttgcaggatttcgccgaaagctacggctttggcagcgattacgtgttccaacggtccgccctgtacacctgggaatacagctgaatccagtaattgagacatcattttgatttcacccttcggagttttctttccccaaggattagggaaatcttttcccatcatgatgaccccaccacgaggtccgcgaagtgttttatgtgtagtcgaagtgacgatgtgtgcatatttaaccgggttctccaacagtccggcagcgatcagacccgcagggtgagccatgtcgatcatcaggatagcgcctactttatctgcgatttcacgcatacgtttgtagtcccattcgcgggaataagcagagccgccgccgataatcattttcggcttttcgcgcaaagcaacttcttccatctggtcgtagtctacacggccggtttcctgattcagattgtattcgcaaggagtgtagataatgccggaagtgtttactaatgaaccgtgagaaaggtgtccgccgtgtgcgaggtttaatcccataaacttgtcgcctggattcaaaacagccagaaatacggctgcattggcttgtgctcctgaatgcggttgtacgtttgcccattcggcaccgaagatttctttcaggcggtcgatagcgatttgttcgctttggtcaactacttcacaacctccgtagtaacgtttgcccggataaccttctgcgtacttgttagtcaggcaagaacccattgcctgcattacctggtcacttacaaagttttcagatgcaatcagctcgatacctttcagctgacgttggtgctctttttcgatgatgtcgaaaattaagtcgtctcttttcattctttttataagtaatattaaatttttaattcgagatacctattttaagcgcacaaagttagtgaaaataaataaagaacgaaggaactataagaaaaatgttagtaaatggaggaaattaatagataatggataatttatcgtacggaatgaataggaggtgtctgtttttgccggttgccgactatcaaaagttcatcagccggctgtcggatgttctttaaagaatgaatccgaacgagaaacttaatgcgctgtcgcggcggcggaaaatgatagggctgactcccgtgctgccgtctgaattgatattgtcataaacgatggatttggagatatttcctatcccctgttcgtagcggaagtcgaaaaagatgcgggagatattgacgccgacaccgatcacgacgctgacattgagcggatacagcttttcatgaatccctttctggtcgaagtttgtgaaagtgatttcgttctgctttccccatagataccggagttttggaccggcaaagatagacattccgtatggtccttttttcactacgttatatccgtagagaatagggaagtcgatactgtgaagtacggactgtaccgaagcataatcgggttcgatggcagggtgttgcgaaccgagtttgtcaaaggtgatctcgcctttgctgacattataggatgcttccggctgaatgaaatgcttctttatattaaagcgcatgaagatcgcgccaaaatagccgatcttataattattttgtacttcgtcgatcgttacgtctttgattttcaattcggataccataaacatggaagaattaaatccggctttgataccaaagttgattttctttgtgttgggacgttccactttatctgcgttacgatcttgggcgaaagctgtgcaagctatcgccatccaaccgaaaagaattatgttgcgcagtatattcatggcagtacttttttctttatttcttcttttctacactccagccgaatttccctattttttctcccaggtcgtaatatcctccgtgcacatataccagcgggttcgcttccgccagttcgaacttgccggtttcgggattcaggttccggtcgtctgcacggacgtttaccacatcggcgataaacatatcatgcgaaccgagcgaaacaatttccttcacgcgacattcgatgcagaggggagactcttcgatcagcggtgcgctgactacggtgcagcgtcccggagtgagtttcatctcttcgaatttacgataattccgtcccgaacgtactccgcaccagtcggtagggaacgccatgtctttagttgtcagattgatgacgaactccatattcttcttgatgatgtcgtaggagtgtcgttccggtcgtacggatatatagcacatgggcgggtttgtacaaatcgtacccgtccatgctactgttataatattatattcactttcatcttttccgcaactcaccaatatggcaggcagcggatagatcatcgttcccggtttccagtcttgtttcaatttaataaaaaattaagaatgaggaatggagaaactagaggatggtgatttcctcgcgtttctgttctttctcgcaataatggcacttcacgatgcaattatccttgtcaatcacatgaaataacgtaggcataggttcattgttcgtgatacatttcggattggcgcattttacgatgccgtgcagctcgtccggcattctgacttctttcttttcaacgacttcatagtcgcggataatgttcagttttacgtaaggtgctactaccgatatgcggttgatttcttcgtcgcagaaaaacttgtcggcgattttgataatgccttttttccctagctttttgctgtcgaggttgaagccgatggtgatgttacacttcatttgctccacgcccagaagttgtacgacagtaaagagtttttctgatgggatatggtcaatcactgtcccgtttttcagggcagctacttgcaatgcttgtttattttcgctcataataaaatatcgtttttaacgtcctctaatgtgatacctaacacgtcgcaaaggatggcttcacgggcatacagaccgttttgcgcctgttggaaataatatgctttcgggttgttgtccacgtcgtaagcaatctcgttgacacggggcagcgggtgcaggatgcggagattcggacgggtgttttccagcatcttgttgcgcaggatatatacatttttcactcgttcgtattccatcaggtcggtgaagcgttcacgttgcacacgggtcatatacaggatgtcggcatcagcgataatttcttcggtaaattcggtatgttcaatgtatttgatctgatgctctttgcagtatagcttatattcttccggcattttcagttcatcgggggcgatgaagtggaatgtaggattgaagtggcgcatagccatcagtagtgagtggacggtgcggccgtatttcaagtctcccaccagaaagatgttcagattttccagtgttccctgagttttgtagatggagtagaggtcgagcatcgtttgtgacgggtgctggttggctccgtctcctgcattgacgatgggcacaggggctacttcgctggcatatcgggcagctccttcgagatagtgtcgcatgacgatgatatccgcatagctgctaaccatcatgatcgtgtctttgagtgtttctccttttgaggagctggttgctttcggatcagtaaatccgatgacgcgtgcgccgaggcgattggctgctgtttcgaaactcagacgggtacgggtggaaggttcaaagaacagggttgctactaccttaccttgcaataaccggcggttggggttcatttcaaactgcttcgccatttcgagcatgtagaggattttttctttagaatgttcggcaatggttactaaacttctgttttccattttgttatcttttatgtggatagaacttgttttaccggagtgtaaaggtacgaagaaaatgtaaaatacaaactttttttctctttttattcgtttttcggttggttttaaaatatcaaataaatcaaaaactcgtttgctgtatgctatattttatctacctttgcggcttaattataagcatcttttttaagctagaagaaacatgattcgaaaaataataaacgttctttgggtattgttggcagttgctttaatagctatcgtagtagtttttgtgtctatctctaaaggctggattggctatatgcctcctgtggaagaactggaaaaccccaattataaatttgctaccgaggttttctcggaagacgggaaagtactgggtacattctcgatggaaaaaaacaatcgtgtgtacagcagctatgccgatctttctcccaatatcattcatgcgctgattgcgacggaggatgttcgctttgccgaacattccggtattgatgcgaaggcactttttcgtgctatcgtcaagcgtggattattgttgcagaaaagtgcgggtggaggtagtacgatctcacaacagctggcaaaacagttgtttacggaaaaggtggcaagcaatactatgcagcgtctgttgcagaaaccgatcgaatgggtgattgccgtaaaactggaacgttactatacgaaagaagagattctgacaatgtatcttaataagttcgacttcctgaataatgctgtaggtataaagacagccgcatctacttatttcggctgtgaacccaaagatttgaaaatagagcaggcagcgatgctggtgggaatgtgtcagaatccgtcccgttataatccggtatccagaaatccgaaaatccgtgagaatgcgctgggacgtcgtaatgtcgtactgcgtcagatggaaaaagccggctacatctcggatgcggagtgtgattctctgcaggcacttccgctgaaactggcatatacccgtgtagaccacaaagaaggtctggcaacctatttccgcgaatatcttcgtggtgtgatgaccgccaagaaaccggttaagagcgagtaccgcggctggcagatgcagaagtattatgaagattcactttcatgggaaacaaatccgttgtacggctggtgcgccaaaaataaaaagaaagacggatcgaattataatatctatacggatggcctgaagatttataccaccatcaattcgcatatgcagcaatacgctgaggatgctatcaaagaacatttaggcgacttcttgcaacctctgttctttaaagaaaaacaaggaagtaagaacgctccgtatgcaagggcattgccgcaggcgcgggtggaagaattgctgaccagagccatgaaacaaaccgaacgttataatgtaatgaagtcggcgggtgcttctgaacaggagattcgcaaagcattcgatactcctcaggaaatgtctgttttcacttgggcaggtgagaaggatacgattatgactccgatggactctattcgctattacaaacacttcctgcgtacaggattcatgtcgatggacccgatgaccggatatgtgaaggcgtatgttggaggaccgaattatacatatttccaatatgacatggcaatggtgggacgccgtcaggtaggttctactatcaagccgtatctgtatacactggcgatggagaacggattttcaccttgtgatcaggtgcgtcatgtagaacaaacgctgattaccgaaacaggagaggcatggactccccgaaacgccaataataaacgttatggtgaaatggtgactctgaaatggggactggccaattcggataactggatttcggcttacctgatgggtaaactgaatccttataaccttgtaaggctgattcatagttttggtgtacgaaacaaggcgatcgaccctgttgtttcactttgtctgggtccctgcgaaatttctgtcggtgaaatggtaagcgcatatacagcttttgccaataaggggattcgggtagctccgttattcgtcacccgcattgaagatagtgacggcaatgtgctttctacgtttgcaccgcagatggaagaagttatcagtgtttcgagcgcatacaagatgttggtaatgcttcgttccgttatcaatgaaggaacaggcggacgtgttcgccgttacggaattacggccgatatgggcggtaaaacaggtacgaccaatgataactcggatagctggtttatgggctttactccatcattggtgtccggttgctgggtaggaggtgatgaacgtgacatccactttggtacaatgacttatggacaaggggctgccgccgcattgcctatctgggcaacttatatgaagaaagtctacgatgacccgactttgggatacagccagacggaaacgtttaaactgcccgaaggttttgacccttgtgccggttcggaaacaccggacggagaagtcttcgaagaaacgggactggacgatttgtttaattaaacctctcatcgtgcataaatgtatcatttgtatcggaagtaactacaaccggaaagagaatcttcttctggctcgcaggagactggtggatttgtttcctaccatccgctttacgtctgaacaggagacacgccctttgtttttcagaagtccggcattgttctccaatcaggtggcgatgttcttctcggaagcggaggaggaaagagtgcgcaaggagctgaaagctatcgagcagtccgccgggcgtcgtccggaggataagaaggaagaaaaagtcagtctggatattgatttgctctctttcgatgaccgggtgttgaagccggaagacctgaaaagagagtatgttgtgaaaggattagaagaattaaaatacaatcagatatgaaatttctgggaataatacctgcccgctacgcatccacccgtttccctgcgaaaccattggctatgctgggggggaagacggtgatacagcgtgtatacgaacaagtagcgggcatcttggatgatgcttatgtggctaccgatgacgaacgtattgaagctgccgtaaaagcattcggaggaaaagtagtcatgacttccattgatcataaaagtggtaccgaccgctgctatgaggcgtgcacaaagatcgggggcgactttgatgtggtagtcaatatacagggggacgaacctttcatccagccttcccagctgaatgctgtaaaggcttgtttcgaagaccctaccacgcagattgctacgttggtgaagcctttcacagccgatgaaccgtttgccgtactggagaatgtcaactccccgaaagtggtgctcaacaagaattggaacgcactttatttcagccgttccatcataccttttcagcgcaatgccgataaggaagactggctgaagggacatacctattacaaacatatcggtctgtacgcttatcgcacggaagtattgaaggagatcaccgctctaccgcaatcctctctggagttggcagaatcactcgaacagttgcgctggctggagaatggatataaaataaaggtaggcatcagtgacgtggaaacgatcggtatcgacacaccgcaggatctgaaacatgcagaagaatttttgaagaacagaagctgatttatggatcgtacgatacaacctgaaatacaagccctgaaaaatttccatatcctttctcccgtccggactactttgccgaacggtgtcccgttgacggttgtcaatgccggtgaacaggaggtggtccgtatggatattctttttgccggagggcgctggcaacagtcgcagaagttgcaggcgctgtttacaaaccggatgctacgcgaaggcacgcagaagtatacggcggcaaccattgcagagaaactggattattatggttcatggctcgaactgtccagttcgtcggagtatgcttatatcactgtctactcgttgaacaagtatctggcaaaaacgctggaagtcgtggaatccatgattaaggaacctgtgtttccggagaaagaactgcataccatcctggatacgaatatccagcaatatctggtcaatacttctaaagtagacttccttgcacaccgtggcctgttacaggcgctttacgggacacagcatccatgcgggcaaattgtagtggaggaggattatcatgccattacaccggaagtactccgtgacttctacggacggcattatcattcgggcaactgttccattttcctgtcgggtaaggtgacggaagatatcatccgccgggtgaccggtgctttcgggactcctttcggacaatatcagctgaaagcatcaaaaccgatattttcattcgttgccgttcccgaaaaacgaatattcatagagcgtgaagacgctttgcaaagtgcggtgaagatgggatgtaccaccattacccgtcagaatcctgactatctgaaattacgcgtactgatgacgctgttcggaggatactttggcagccgtctgatgtctaatatccgtgaagagaaaggatatacttatgggatttctgccggaattatgttctatccggatagcggtttgcagggaatctcgaccgaaacggataatgaatacgtggaaccgctgatacaggaagtatataatgagatagacaaactacaccgggagcctgttcctatggaagaactgacgatggtgcgcaactatatgctgggcgaaatgtgccggagctacgaatcgcctttttcgctggcggatgcgtggatttttattgctacttcggggctggatgaccagtatttctcccgttctttgcaggctgtaaatgaggtgacacctcaggaaatacaggaattggcacagcgctatttgtgcaaagagacattaaaagaggtcattgctggtaaaaagttgtcataatttgctttccggtatggcactttttgggagagaagttgtatctttgtccaaactgtaattttaatgagtaacgagtaaaactaatgaggaaatatctatatactacactttttttgactcttcttgcacagggaggagtgatggcacaagataacaataccagcaaaggtgggttcttcggaaagttgaaagacacattctctacagaaataaaaatcggaaattatactttcaaagatggtagcgtctatacaggagagatgaaaggacgcaaaccgaacggaaaagggaaaacggtctttaaaaatggggatgtctacgaaggggaatatatcaaaggaaaacgtgaaggctacggaatctattcttttccggatggagagaagtacgaaggtcagtggttccaggatcagcaacacggaaaaggaatctattattttatgaataataaccgttatgacggaatgtggttccaggattatcagcatggtgccggaacgatgtattatcataatggcgacttatacgtgggcaactgggcgaacgacaagcgtgaaggcgaaggtacttatacgtgggcgaatggtgctaaatacagcggtcactggaagaatgacaagaagaacggcaaaggcaccatgaactgggacgacggctgcaagtacgacggtgactggaaagatgatgtacgtcatggaaaaggcgtattcgaatatactaacggagataagtacgatggtgactgggcagatgacatccagcacggaaaaggtacttattttttccatacgggagatcgctacgaaggttcttatcttttgggagaacgtaccggagaaggcgtttactatcatgccaatggagataaatatgtaggaaacttcaaagacggtatgcaggatggaaaaggtaccttcacgtgggcaaacggtgctgtgtatgaaggtgactggaaaaacaataaacgcgaaggcaaaggtatctataaatggagtaacggggatgtttacgaaggagactggaagaataatcgtcctcacggtcagggctctctgaaaaccgttgccggtatgcaatataaaggtggtttcgtagacggactggaagacggacaaggcgttcagatcgacaaagacggtaaccgcttcgaaggcttcttcaaacaaggaaagaaagatggcccttttgtggaaacagataaagacggaaaggtgatcaaaaaaggaacctataaaatgggaagacttctttaaaagaaagaattatagataaataagaaagccggctaaattcaagtttagccggctttctttatcttatcctttactcatcattcttcatttagatgatatattgtgaactgatggactcgttattcattacccgcttgattgtttctgcaaacatatcagcgatgctcagttgtttcactttcgcgcatttcttagcgtaagggatactgtctgtaaataccatttcagtcaatccggattcctgcacacggaaagaagcagggtcagacattacacagtggctggcaatagcgcgtatggatttggctccggcttccatcatgatattggcagctttggtgatggtgcctgctgtatctacgatgtcatcgatcaatactacgtttttgtctttcacatcaccgatgatttgcatggaagctacttcattggctttttcacgtgacttgttgcagagtaccaaaggtacaccaaggtatttggagaaagtgctggcgcgttttgaaccacctacgtccggtgtagcaatcaccaggtcttccagtttcaatgactggatataggggaggaatacggctgatgcatacaggtgatctacggggatattgaagaatccctgaatctggtctgcatgcaaatccatggtaatcagtcggtcgatacctgctactgaaagcaggtcggctaccaatttagctccgatagatacacgaggtttgtcttttctgtcctgacgtgcccatccgaaataggggataacagctacgacgctctttgcagatgcacgtttggcggcgtcgatcatcaggagaagttccattaagttgtctgagttagggaaagtagactgcacaaggaatacatgtgcgccacgaattgattcttcgtaagaaacggcaaactcaccatctgcaaagtgggtgatgttcatgtttcccagaggacaattgagacttgcgcagattttctctgcaagatatctcgagttagttcccgagaataccataaagggtgctttttcgctcattttgtaatagatgttacctatttgttaatttgcctgcaaaggtaggaatttctcttattatttagaaagacttattgtagaaaaaataattttctctccaacttatcggaaatatttgtagatttgcaagtaagaacgaagaactgagaatgaagaatgaagaattatggacgaaaaacagaaaatgaagagcgaagaatgaaagatagttatcgcctgtctttttattctccattttccattttccattctccattatatataataggagtattgttgctttcctcccttttttcgtgtaccgacatggtgcccacaaaagaagtgaggcttatcgactcgctgaatggaaaagcgtatgcttatcgttaccgtaatctggactcttcctacaaatacgcctataaagcatatcggcaagtaaacctatataagtcgggaaaagcggaagcttccaataatctggggttctgtgctttcatgaatatggatttcgaccgtgccgaggcgtatcataaagaggtatacaagctgactaaaaatgagcttgagctgttgattgcagacatcggactgatgaaaatctgccagcggacagcgctcaacaaagaattttatgattaccggaacagtgccctccgacggatgaagcgtattcgtgaagagagcgacctctttgccgaccgtcacgaagcgcttcggctggattacgcatttaccgaattttttctcgtttcctccatttactattactatctccagcaacggcaggaagcgataacctctatcgataatattcaggaagacgaagcgttgagcgataccaatcagcttctttattatcattatctcaaaggatcggcttctttggtcgcagcgaatactccggaagaacggaaacttcgcgagtttgacgaactttatttcacttggcggacagccgtgaagagcaagcatccgtattttgaggggaatggaatgcagggacttgccaatctgatggcagccccgtctaattttgagtttttcaagacaaggcgtacacatgcgttggatcagtttgattttccggtagattctttgttccctttgcgtttggcccaactggcactggagaaatttcgcgaatataatgacttgtatcagattgccggagcttatgtatctatcggcaaatacctgaatgcgcatggacgttatcaggaagctttggatacattatcaaaagcattgaactgcgtaaaccatcatcacatgctttattatcataatgaagtggatacgcttgataaattatatacgtttgccgagggagatactacttataccggagttccatggattggacaggagaaggtgaagaccgttcccgaatggatctcacggataagggagcagttaagcgtttcatatgccgggctggggatgaaggatgcttctgattataaccggaatatctatctggatattttgaactttactcgtcaggataaggagttggaaagcaggaaactttcactggaagcaggttcacggcaaatgacactggttctttttttggttattgttggtctgatattggtgattatcctttggtggttcttcaacaaacgttccaaaatcaggaatcaggtggatgtggagcgtctgcaacggattctctctctttgtcgggatatcacttcttccataccgatgaatatacctttgattcagcagggcattgatcagttgttcgggaaaggacgtctgacgctggaaattccggaagaaggaaaagctgcactggtgccctcttcccatcggctgaatcgagacgaaaaagcactggtacacgtcttggaaccttatattgtgtgggctgctgaaaatgaacaaatggtagctgcgttgagcgatgagcggattcaactggagaagcaacggtatatctacgaacagcatattgcaggaaacaaacgtcagaatttgataaagaaagcttgtatggccattgtgagcggtatcaatccttatattgaccggattctgaacgaggtacataagctgacggaaaaaggatatattgatgacgccaagataaagaaagagaagtaccagtacattgacgaactggtgactaccatcaacgaatacaatgatattctggcactttggatcaagatgaagcaaggtacgcttagtctgaacatcgagacattcagcctgaatgagttatttgatttgttgggaaaagggcggcgtgcttttgagatgaaaaagcaaaagttggaaattgaatcgacaactcttatggtaaaggctgaccgtgcgctgaccttgtttatgattaatacactggctgaaaatgcccgtaaatatacgcccggaggaggaatggtaaaagtatatgcgcatgctactgacgcgtatgtggaaatctccgtagaagataatgggagaggactttcagcagaagatatcgcgcatatcattggtgaaaaggtatatgattcgcgtgctatcggcatgaaagacgcggcagatccggaagaactgaaagagaataagggaagcggttttggtttgatgaattgcaagggaatcatagagaaatataagaaaacaaatgaactgttccgggtatgcgtattcgatatagaaagcgaaccgggaaaaggaagccgtttttattttcgtctaccttcgggggtacgtaaagtgattggcgtattgctttgcttgttgttgcctgtagggtttggctcttgtttgcagactccgacatcacctattttgcaaaataaagattcaattgttattataacagattcaatttatgaagaattgcttgatatagcatcatattatgccgatactgcttattctgcaaatgtacatggaaggtatgagcttgctctgcaatatatagatacagcgatgatgtttctgaatgaacattatgagaaatatgcgcattctaatcagccacatcggcatatgaaacttgtaggagaaggaatccctgcagaaatatggtggtggaatgaatattttgactcggattatcatgtaattttggatatacgaaatgaggcggctgtggcttttcttgcgctaaaagagctggacgcatatagttataataatgctgcatatacagatttatataaagtacagggggaagaccaaaatttggaaggatattgcaggcagttggaacgatccaacacgaataagacggttggtatcatcctctgtttcgtcttgctgatcgtttctctgatcggctattatctcttgtatatgaggaagatgttgcagaaccgtctgaacctggaacaggtgcttgagataaatcagaaagtttttgccgcctctttggtcagacctcagactcaggagaacgaggaagcgcttcagagggaggaaaatacacttaaagagattccgcagcgcatcgtgaatgaggcttttggctcagtaaatgagttgctgacaatcagcctgatgggcattgcagtttataacgaaaccacgcatcggctggaatatgcttcctgtcccggacaggaaatgccggaaatggtgcagcaatgttttgaaacgggggaatatctctcagaacagaatttgcaggcgattccgttgatggtggaagccggaggtgagcatcaatgtgtaggtgtgctttatctggaacggagggaaggaacgcaacaagaaacggatcatcttctttttgagctggtagcacgttatgtatcgattgtggtgttcaatgcagtggtaaagcttgccacgcaataccgggatatcgagtcggcacacgaggaaacacgccgtgcttcgtgggaagacagtatgcttcatgtgcagaacatggtgcttgataactgcctttcgacgattaaacatgagacaatttattatccgaacaagattaaacagattattggtcggttgaatacgcagaaccttccggaaaaggatgaacgggaagctgtggaaacgattacagaactgatagaatattataaagggatctttacgattctgagttcatgcgctgctcgacagctggaggaggttactttccgccggaatacgattccggtacaggagctttttgatgctgctggaaaatacttcaggaaggtcacgaaaaatcggacggaaaaggtagaactaatcatagaaccgatggacgccaaagtgatcggtgacgtgaatcagttgcgtttcctgtttgagaatctgattgatgaagcattggcggttcgtgaagaaggagtgatacgcttgcaggctcgtaaggataacgaatatatccgtttcctttttacggataccaggcgcgagaagagtgtgacggagctgaaccagttgttctatccgaacctggctcgtatgacttccggcgaaaaaggggagttgaggggaacggaatatctgatatgcaagcagattattcgtgaccatgatgaatttgcggggcgcagaggatgccgtatcaatgccgaaccggcagaaggggggggatttacggtttacttcaccatcccgcgcagataagaaagaagacacataaaagttattagataaataaaatggaagaacagaagtttaaagttattattgtagaggacgtaaaactggaattgaaaggcacagaagaaattttccgtcatgagatacccaacgcagaagtgatcggcacggcaatgacagaaagcgagttctggccgctgatggaggcacagcttcccgatctggttttgctggatttgggactgggaggttctacgacgattggcgttgatatctgccggaatattttcaaacgttacaagggggttcgtgtattgatctttacgggggaaatactgaatgaaaaactgtgggtggatgtgctgaatgcaggagcggacggcattattcttaaaacaggagaattactgaccaagacagatgtacaagctgtgatggacggcaagaagctggtattcaactatccgattctggagaagatcgtagaccgtttcaagaagtcggtagcgaatgatgccaagcgtcaggaagcggtaatcaactatgatattgatgaatatgacgagcgttttcttcgccatctggcattaggctacaccaaagatatgattgccaatctgaaaggaatgccattcggcgtgaaatcactggagaaacgacagaatgacctgatcggacgtctcttcccgaatggagaacgggtgggagtgaacgcgacccgtctggctgtccgtgcattggaattacgcattatcgatctggataatctggaagctgatgaagagtaaatggcgtatgccgcatcccgctacgatgtttctgctgctgacaatggcggtggtctttctttcgtggatatgtgatatctacggactgaaagtaacgctgccgcaatcaggggaggatattcgggtgcaaagcctgctgagtcctgagggaatccgctggtggttgcggaatgctatcaagaactttaccggttttgctccgctgggcatggtgattatcgccatgttcggactgggggtggcccaacattccggatttatcgatgcgtgcatccgtctgggagtgggaaaccggaaagagaaaagaaaagttatcctgtgggtgattgtcctcggattgctgtcgaacgtcattggggacggcggttatattattctgcttcccattgccgccatgctgtttcagtgggtgggacttcatccgatagcggggattgtgacggcttacgtttccgtggcctgcggatatagtgccaatatcgtactgagtacgatggacccgctcttggcgcataccactcaggaagccgcgctcacactgatgggatatcagggaaacacggagccgctgtgcaactacttctttatgagtgcttcgacagtggtaattaccgggatcgtttattgggtgactcaaaaatggcttctcccgaacctaggaaaatatgagggtagtgtgaaagtcgaagcctaccgccctttgtcacggaaagaacgtcgtgcgctgatggtggctgtcacagtggcagggatatacgttgcccttattttgtggcttactttctcctcctatggtatcctgcgtggcgttaacggaggtttgatgcactcgcccttcatagccggtatcctgtttctgctatctctgggcgcaggttttacggggatggcttacggattcagctccggtcgttatcgcagcgataatgatgtgattgaaggacttacccagccgatcaaactgctgggtgtatatttcgttattgctttcttcgctgcccagatgtttgcctgtttcgagtattctcatctggacaagtgtcttgcgattatgggagcggacctgctctcttcttttgagccggctcccttgtccgcactcatcttgtttatcctgtttacggcgtttatcaatctgattatggtatccgccacttccaaatgggcatttatgtctttcatcttcattccgatgtttgcgcagatggggatttcgccggacgtcacgcagtgtgctttccgtatcggagacagttcgacgaatgccattactcctttcttattctatatgccgctggtgttgacgtatatgcggcaatatgacaaacagatcacatacggatcgttgctgaaatatacatggaggtactccttgtgcattctggcagcatggacgttgctgtttatcgtctggtatctgttgaagataccgatggggctataattcacgattcaaagttccggttttaataaccggaattttgagtttctgaattaatcgctatatttgcacccgtcccttaaagaaaaagaacgaatgaatttaccagaagtctctgaaaaactaatcgaacaactgaatcacggtagcaccaaagcatttgataaaatttatcatacgtactatttatacctgtgtgcgatagctgtttactatgtacatgacaagagagtcgccggtgaaatagtcaatgatgtcttcgtctctttctggcagaatcgccaccatatcacttatcctgcccttccgtatcttcgtcgggctatacagaatgcaagtatcagttatttgcggtcttccgcttttaacgagcgcataatgaccgaacagatggaggaaatatgggcttttctagaaaatcatattctttcttccgacaatccattgcaggcattggaaagcagtgaaatgaacgagatcattctgcggaaagtagaggaactccctgccaaatgccgtgctgtttttaaggcgagcctgtatgaaggcaaatcgtacagcgaaattgcggaagagcagaatattaatgtcgccaccgtcagggtgcagatgaaaattgcgctgactaaattgcgcgaatcccttggtactccctatatgatagctattttgatgtttctttaaaaaaaatcggttttcttttaaacgtttctttttttattgcgtatctagttatatacaccatagaaaaagaacggtttatgatagaatattacgataaagaagaactggaattacagattagtaattatttgtcgggcaatagtaccgatgaagaaaaagaaacgttgcttgcctttctggcttccaatgaagcagctgcccggactttccgggaaatgtctgccgtatgggcactttcttccgtaccgtcgtttgcagaaatagaaaactccaatttagtgcggataaaggagagaatgactgctcctgcctcttcgaagcctgtccggaaactgatacctgtctggctgaaagtggctgccgccgttattctgctgatcggttgcaactatttctggtatacgtatacggaaaatctgacggaagtatataccaacgccgattctccttacgaaatcaaggttcctgccggatcgagaacgaatatcgttcttcctgacgggacggaggtttctctgaatgcaggttctgtattgcgctatcaccgtgggtttggtatccgcgaacgtaatgtgacgttggatggcgaaggatactttaaagttgcgaaaaatgcagaggttcccttcttcgtgaagacgaacgatgtgcaggtgcaggtagtcggcacggtattcaatgtccgtgcttatgatgacgataattatgtgatggtgtctctgctggaaggcagggtgaatttatcggcgtctgctaattctgtgatgaaattattcccgaatgagcaggcactgtataacaagaacaccggacgaatggaaaagctgaagaccaatgcaagtaaagcctgcgattggctggatggcgggttgaccttcgagaatgcttcattcgctgatattgcccatcgtctggaacgtaaattccaggtgaagatcagcatagaaagcgaacgtctgaaggccgaacacttctccggttccttcgacagcaatcagaatatttatgatatattacacgaaatcaacgttgagaaacaatacacgtggaaagtcagtggtgacaccatctttattaccgataaaagaaagggggtaagataaaaggaaggagaaagaaaatggacacagccgatagatatatcggcagtccgcagctacgataaataactatatgttaacctttaatagtgataaaaatgagattgataataagaaaaacattattgatgtttctgcttttgtccctaagtaatgtcctgacaggttttcaactttcagcacaggaacaaaacaagaagttcagtgtcaaagcagataacgttactttgaaagaagccattgaagtagtcaggaagcagggaaattattcttttctgattcgcaataacgacattgacctgaataagaaagtctctgtgaacgtggacaagggtacgattaatgacctgatggcccaactgctgaccggtacggggatcagttatgaagtaaacggaaaccgggtggtcatattccatgccgcagtgcctgaaaaggaacagggaaaagcgtttgtcctgaaaggcaaagtgaccgatccttcgggtgaaggagtgatcggtgccaatgtgaaagtgctgaattctacggaaggcacgatcacggatatggatggaaacttctctctgtcggtgactccgaatgcatgtttgtccgtgtcttatatcggatatgctacgcaggaagtcgtcgtcaagaatcagactcctttgcacattgctctgaaagaagacagccgtctgattgacgaagttgtggtagtaggctacggtgtgcagaagaaagcgaatctgactggtgcggtaagcagcgtgaagatggatgaagtattgggagaccgtccggtagtgtcggtcagcgatgccttgaaaggtgcgatgcccggtttgcagattacgggtaactccggtagaccaggagaggaaatgagtttcaatatccgtggtgtcaacagtctggataagaatggcaaaccgttggttctggtggataacgtagaaatggatatcaatatgctcgatccgaatgatattgaatcagtaacggtcttgaaagatgctgcttcttcggctatctacggggcacgtgccgcatttggcgtcattctgattacgacaaagaaaggatcggattcaaccaggctttctattaattattctaacaatttctcatttagcagacctgccaatatgcctcgtaaggcaacaccgcttcagacggtgcaggcttataaagacatgggaaccatcaactatcagagtggacagaatgtggatacgtggctggatttattaaaagaatacaatgccaatccttcggcttatcccgatgggtatgcaatggtggacggattgcgctatagtctggcagaaaccaatctgtttgatgatatgatggagaccggtttccagcagacgcacaatctttctgtaggtggcggcacgaaagatatatcttatcgtttctctttcggtatggtcgatgagaatggagtgctggcctcggacaaggatgcgtataaacgttacaatgtgtcttcttatatccgttcggacgtattctcatggattactccggaactggatatcaaatatacgaactcgaaatcagaattgccggagacttcgggaggatatggaatctggggagcagccgttgccttcccgtcttatttccctaccggaacaatgaatatcgacggagaagaactaccgattaatactccccggaatctgattaatcttgcttatccgacgactatccagaaaaacaatatccgtatcttcggaaaggtgacgattactcctttgaagaacgtcaaactggtgggtgaatatacatacaaccatctgagtaatgaaaagaccaagtttgaaaagaagttctattatgcccacggaggtaactttgtgaaagagacttcgacggcaaactctaagtatgaaaactccaacggcattaccgattataatgccctgaacttctacggaaactacaataacacatggggcaagcatgaagtcaccgtgatgggaggtttcaatcaggagagcagtgactatcgctatgcggaaatgtcgcgtatgaacatgattaacgaagaccttccttctatatcgcaggctacaggagattatttcgctaaagataaattcgaacgctatacagtaagaggattattctatcgtatcaactactcctttgccggcaaatatctgattgaaacgaacggacgctatgacggctcttccaaatttccgaaagacagtcgcttcggtttctttccttctgtctctgccggatggcgtgtgagcgaagaagcgtttatgaaaccgttgacatccgtattgtctaactttaaattgcgtgcttcgtggggtaatattggcaatcagagtatcactccttacgcttatattccgggcatggatgccgagcaggcttactggaccgtttcgggtatcaaggtaactacccttaaaccagctgcattggtcagtaacagttttacctgggagaaagtgacgactgtcgatgtcggttttgatctgggtttattgaacaacaggctgaatcttgtattcgactggtatcgtcgtgatacgaaaggtatgctcgctccgggagcggaattaccggctgtgctgggtgcaagtgctcctttgcagaatactgccgatcttcgttccaaaggatgggagatcactgtagactggaatgatcagatcggaaaagtgaaatacaatctgggcttcaacctttatgatgctaaaaccaagattaccaagtataataacgagacaggtctcttcggcaaggataagaacgataaagatacttaccgtgtaggtatggaactgggtgaaatctgggggtatgttaccgaccgcctgtatactgttgatgattttgatgccgatggcaagctgaaagcaggcattccaaaagtggaaggctacaatccgaatccgggtgatatcctgtataaagacctggatgacaacgatattatcaacggaggcacaagtaccacgaaagatccgggcgaccgtaagatcatcggtaatagtacccgtcgttatcagtatggcatccacggtggtgcaagctggaaggggttctctttatctttcctgttgcagggagtaggcaaacgtgatttgtggattatgaatgacttgttctatcctcactatgatgcatggacgacggtatatgacacacaactgaattactggacgccggaacgcacagacagctatttcccccgtctgtatgagaaagctgccggaaatactgctgccaatacacgtattcagacccgttatctgcaggatggttcctacctgagtatccggaatatcaccttatcttataatttcccgtccaagtggatgaataagatcggtgtcaataatctggctgtattctttagcggtgagaatctttatacattcgatcatttgccgaaaggactcgatccggaacgttcggtaacggatgacttgggacaacgtggttttacctatccgtatatgcggcagtattcgtttggtatcaacctttcattctgattgtttcactatttaaaagagtaattattatgaagaaatatatactgggtacgggcattagtctctgtttgctgatgtcgtcttgtttgaatgactcttttctggaagtttatccgaaaggacaacagacggaagcgacagtctttactacctatgataactttaaaacgtatgcatggggattatataatgtattcttcggatatacgtatgatacgggacagacggacgaaatattccggggagattttgagtcggacaatatgatcaagggtttgtccggatatgaagggcagtgggcataccagaaggcgaaggcgacagatgaagccaaggaatgggattacgactatatccgccgggtaaatctgatgctggacaatatcgacggttcgcagatgaatgatacggagaaggagcactggcgtagtgtcggctatttcttccgttcatataaatactttcagatgctttcccgctttggagatatcccctgggtggagaatgcgttgaaagaagacagtccggagctgtacggcaaacgggataaccgcgatctggtggcttcgaatatcctgtccaatttgaaatatgcggagacacatatcggtgcggacgacggcaaaaacaccattggtatatctgtggtgcaggcacttatttcccgttttgccttgttcgagggtacttggcggaaatatcatggattgtctgatgccgagacttacttgaaagaatgtgtacgtgcgtcggaagaagtcttgaaggtttatccgaatgtacatccacagtatgatgagcttttcaattcggagtctttggatggggtgacgggcattatcttgtataaagcctatgaaaccggtcagttgatgcatggcctgacacgcatggtgcgtactggtgaatcttatattgaggcgacaaaggatgcggtagacagttatctgtgtacggatggtcgtccggtaagtactaccaccagtcggtatggcggtgataaggagatttatggacagttccgcgaccgtgattaccggttgtatctgacgatatgtcctccctatatggtaaagaaagaaaatggtccgagcacggctgactggaaatatacggatgatgcgcaggacagagagtttatagatcttcttgctacgatctccggtgagacttatcatcgtttgccgtcttccaacttcaaaggatttacggtgcagggacagccgcacttcaagaatcagaattggggacagggctggaatgcttctcaaatgggattctgggtatggaagtattataatacgcataccgtagctaccaatgccaacggagtgaatacaacggatgcgcctttgttccgtgtaggagaggtgatggtgaattatgccgaagccatgtgcgaattaggtaagtttgatcagacggctgccgataaatccattaataaacttcgtgcacgtggacatgtagcgaaaatgacggtcgaagacattacagatgattttgatacggcccgtgatccttccgttcctgctcttctgtgggaggtacgcagggagagacgtgtggaactgatgggggaaggattccgtctggatgacctccgcagatggaaaaaaggagactatgtcaataaacgcccgttgggagtatatgtgacgggagcttcggctaaaaatctgaaagtgaccggcggaccgagtaatgacgaagggtatgtttacttctttgacgctccgctcggatggcaggaacattattacctgtatccgctgcctctgaagcaactggcattgaatacgaatctggaacagaatccggtatggactaaataattttttgagtaaaaacagaggcaagacctgtaatattttgtatattgcaggtcttgaaaatttaaactataaaatgaagaacgctatttcggtaaaatatacccttctttgcgggacagcttgctgtatggcctctgctgtgcaggcgcagcgcaatgtctccgatgtttccagaatgaatgttctttttctgatggctgacgatatgcgtcccgaactgggttgttacggagtggaggcggtcaagactccgaatatggatcgtctggcatcgagcggagtcttgtttcagaacgcatattgcaatgttccggtgagtggcgcttcccgtgccagcctcttgacaggcgtatatcctcactatcccgatcgttttgtgaatttctcggcttatgccagcaaggattgtccggaggcgatacctctttccggatggtttacaaagaatggttatcatacggtttcggatggcaaagtttttcaccacatgagcgatcatgctgcatcgtggagcgaacctccctaccggaatcatccggatggatacgatgtctattgggcggaatataataaatgggaactttggatgaactcagaatcaggcaagacgatcaatcccaagactatgcgcggaccgttttgcgagtcagcggatgttccggatacggcatacgatgacggaaaactggcggaacgtgccattcgcgacctgcggcgtatgaaagaaatgaacaagccgtttttcctggcttgcggattttggaaacctcatttgccgtttaatgccccgaagaaatattgggatttgtataagcgggaagagatacctttggctcccaaccgtttcagaccggaaggcttgccggaacaagtccgtaattcgagtgagatatatgcttatgcacgggtgtctgatacaagtgatgctgattttcagcgggaagtgaagcatggatattatgcttgcctgagctatgtggatgcacaaatcggaaaagtgctggacgctctggatgagttaggcctggcggagaatacgattgtggtactgttgggagatcacggctggaatctgggcgaacatgattttgtgggtaaacataatctgatggaccgttctactcatgtgccgttgattatccgtgtgcccggaaggaaaaaaggaaagacccggtcgatggttgagtttgtagatttgtatcctactttgtgcgagttatgtcagataccacaaccagcagaacagttggatggacagagctttgcaaaagttttcagcaatctgaaggctaagacgaaggatgaagtctatattcagtgggaagggggagacaatgcggttgatcaacgttttagttatgccgaatggatgaaaggggacgtgaagaaagcaagtatgctgttcgatcatcggatagataaagaagaaaacaaaaatagagtcaatgagaaaaaatataagagtaaagttgaatcactctcttcttttatcaaagtgaagaaatcatcattaaagaaataatatgagaacaccaattatgtcatgctgccgcttgatggcagctgttttattcctgttttgcagtatgccgctctttgctcagcggcaggatattttattaaacgacaactggaagttccggttctcgcatcaggtgcagaaagggtcggaaataagagtagatctgccccatacctggaatgcgcaggatgctttgtccggaaagatcgactataaacggggaatcggtaattatgaaaagaagctgtttattcgtcccgaatggcaaggcaagcgtcttttccttcgcttcgaaggcgtgaacagtatagcagatgtatttatcaatcgccgtcatatcggcgaacatcgtggaggatacggagcttttgtctttgaaataaccggagaggtgaattatggaaaagagaactctatattagtgcgggtgaataatggagaacaactggacgtgatgcctttggtaggtgactttaatttttatggcggtatttacagggatgtgcatctgctgatcactgatgaggcttgtatttctcctttgaattatgcttctccgggagttcgtctgatacaggatagtgtcagtcatcaatatgcgaaagtaagggcggtcgttgatttggcaaatggcaataatgccggtcaggaagtagaactgggtgtccgtttgctggatggtcagaaagtggtggcgcaacagaaacagacacttactcttgccgggaatgcagctttgcagcaggaacttacatttgagataaataatcctcatctgtggaatggtcgtcaggacccgttcctttatcaggcggaggtatccttgtcgagaggagggcagttggtagattgtgtgacgcagcctttaggacttcgttattatcggattgatccggataagggattctttttgaatggcaagcatctgcctcttcacggtgtttgccggcatcaggacaggagtgaggtgggtaatgctttacgtcctcagcatcatgaagaagatgtagccctgatgctggaaatgggagtgaatgcggttcggctggcacattatccgcaagctacctatttctatgatctgatggataagaatgggattattgtctgggcagaaataccttttatcggtcccggaggatatgatgataaaggatttgttaatctgccttctttccgtgccaatgggaaagaacagctgaaggagctgatccgccaacattttaatcatccttccatctgtgtatgggggctgttcaatgaactgcttgaattcggtgataatccggtggaatatatcaaggaattaaatgagctggcgcatcaggaagatactacccgccctaccacttcggcaagtaatcaaatgggtgacttgaatttcataacggatgccattgcatggaatcggtacgacggatggtatggaggcaccccggccgatttaggacgctggctggacggtatgcatagagatcatccggaaattcgtattgccattagtgagtatggtgccggtgccagcatttatcatcagcaggattcgttggtaaaatccgtgccaaacagttggtggcatccggagaactggcagacctattatcatatagagaactggaaagcgatttctgcccgtccttatatatggggtagctttgtatggaatatgtttgatttcggtgcggctcaccgtacggaaggtgatcgtccgggaattaatgataaggggctggttacctttgaccggaaagtacgtaaagacgcgttctacttttataaggctaactggaacaaggaagaacctgtgctttatctggccggaaaacgtaacaccgtacgttcccgacgtctgcaaacgattactgcattcactaatcagcccggggcggaactgtttgtcaatggaaaaagctatggtaaggcaatgccggatcagtatgctattttggaatggaaaaatgtggagttgcagccgggagagaatgaaataaaagtagtttctatcaataaaaaagtaaaattgatggatagttttcgctgcaaactatagcataatgcaatagaaagcattacctttgcggtctatgtgtaaagctaagaaggagtccgtgaagtaaataacctttggcagtctgtcaaggttatcccttaattcatactctggcatattcttgccagagttattttcatattctatataataagtataatcgcatgtctataagacggataataactatctgcaagatatacatgctcaaaaaaacaatgaaatgataaattcaattaatatacaaattagagagaccaatacagatgatttcgacagcataatgactgttgaaaaacaagcgtttggctatgacaaagaagcacagttggtagccgacctgctggctgacaaaaccgcagaaccaatggtttcgttgctcgctttctacaaaggtgaggctgtcggacacattctcttcaccagagcctattttgatggtcagggagcactacagatgatgcacattcttgcacctttagctgtcaagccggaatatcaacggcagggtataggcggaatgctgatacgggcaggcatagagaggttacaggaaaaaggttcgtgccttgtgtttgtattggggcataaagaatattatccagaatatggttttataccggatgcagccaggctgggttatcctgctccttacccgatactggaacagttctcggattattggatggttcaggcaatcagtccgaagggatttgatgtggataaaggaaagatcaggtgttcggatgagttgaacaaacctgaacattggagagatgatgaatcggacagatagttctctggtagtagtttattaaaatagaggaaatatataaagatttaggtagctttattagtgcagcctaaatataagacttatttttatgtggggctgtccaaaatcggacagccccttttttagatgtattagtattttctattatctttcatcgccttcctccacctcttaaaagccctcatcaggctatcttccttcactgtaccttccatattataatgttccacaaaaagctctattgagcgtttgaacatgattccgtttttgaatttattctccagcagaaattcatagagttccgctctcatttccacttcgatttccttttctatggttaatgcggcggatataggtggatgaagagatatgcaataagcattgattgatgaactatattaaaatcgaaagttatatatggagatgagaaaaaagatcgtagtccggaggaacgattcagctatattattcgttgtgccaatgagcagtctggttgcggagtagtggtattggtggatgaatacgataaacctctgttgcaggctttgggtaattttatttatagaatatcgggtggatgccaacaatccgcttccattgatttatcagagaggttagctgattatcaaggactatgacaaagaatttcaactttatcgtttggctttccctaatgaagaggttcgttatggtttccttaatttttgggttccttattacacaccggtcaatgaagatgagaatttctatataggcaaattcgttcaggaatagcgtgtcggaaaggtacctgagcccgataaaaagaagtttggttgattgcgtcaacaattcttctatcggtctcaggttgttttatttaaaactgcttttcaatataaatacttcaaacgtttttaatagtatcaactggtgtctttccgaaatacttcttatatttttcgcggaagttatccatatctttcattccgattttctctgggacttcgtttacgcgatattttccactctttaacatttcatgcgctttttccattcggattttgagaatgaatttgttaagtgcttcgcctgttaattgcgtccacttgttgtaaagacttgtccggctaattccaagctctttggcaatggagtctatggttagtttttcattattcagattttccagaatgattttagtaactttacttatcaaagggtgtttaccatcctgcaatatttctgacgcttttgtctccaaaaactcttctccaaataatcgttgtaagaatgattttcgaagaaaacgagtgtttttgataaggattgacatttcaagctttaaatctgttacactaaagggctgttgcaagaatgtatcggctaaagaagtctttcttctattgtgctggttaatatctatatgcgaactataaagtatgataggtatgattgatgtttcgcaagatgttttcaatcttgatgagagttcgacaccatccatgttttgaagttctgtatcacaaatcactaaatcaggatattcattttttatgtaagccatcgcttcgatgccatctctaaaacttttaatagtaaactcttccgttaaacaacttgtcagataggatcggaaatcatcattactgtcggcaagtacgactgtcggcttgtgagaacttcttttacagggagcctttgaaagcaaacgatctatcttttcaatctcagtatgattggtgatactcaatgccgaatgatttaattggtttttacaagagcattttactggaaactttaatgtgacagtatgatatgtactgtttactatgatttttccattacacaaattcgttagtttcttatataatatgctttttgcaaaatcgcattcaaattctgttgtctgtctcatcaaccgatgtttattttgattataaagctttgtcagtttaccatctcctgaatcgggtacacttatttcccaatgttcctgactgatagaaatcagtaatgtaatgtttgtttttggtttggaacagtcgattgcattagttatgaatttatcgataattggtgagactttgcttttgtcaaaccatacactggcataggtgaagtttgtattgatgattagttttatgtgtttattcgttgcatagccttgtagggattgaattctgcttcttacatagcttcctaattcatgttcggtaatgtccatggcttcgggatgattatgcaaatatttcaatccggacaatctgtccagattctcatttaagcattctatattccgaatagctagtaataaatcattcttcatattctcgggacaggtgtcactacagatcgttcgtaaaggaacatggactaaggtaattggatttcgaatactttggaaagaatctataaaatactggttctcttctttgaggaaatttctttctttttgtatggaaagataatgaaataaatgccagtagagatagaaacttattacaatcaacaataaaactaagtatgattgattctcaaatattgttgctattaagaaagatgcagcaatagatattgtctttaaatacatcatgttgttatattttaaatgacgtcactcctaaagagtttgctttttctttctaattcaaaagacatagtagattatatgccaactatgatttcataattgtgcacatctataaactcaaataatatgatctcaaatttgtttgttttttgggaggtcaatattgatcatgagttatgtttattgaaaattcaatttctaaatgtcttgaactatcaataaaaaagcaaagtcccccaagtaacaataattattttcatttatttgtattaggcataataaactagcctcaggtgaataatcaggggaggaggcgatcttatattatgtatgctatcggaccatgatgtctcaagagctgtttgtttgtgctcaatcatgaattaatatcaaataaaatacatttgttcccttctgataaagcaggaaattgtatttacgaagtaaatgtaacttgtaataacatgaaaacaattattttgtttgctttatttggtagattgttgtaaaattatttattttgtttattaattaactgaaagttgtataattgccttaggttaacacaaagtatattgtaaatgaaattttggaatttatagatgtaagatagaatgatgaatttgtgttttaaaataaaaatataaatatgtgatataataatgtacttatatgtattaaaaggtgatgaatatacactaatagtatgcaagttggttattttagttttctacttttttttcttgtcccttttttgttttaagcagatgtctttgtttaaaaaactttattccaattcatctgcgcacgattttatcttatcctttcattccctaagaagatggagtagttgtgatctgtggcggatataggtggatgagaagatttaaagtataaaccgacctatgaatttcatcttccatcttttttttagtaattttgcccaatcaactcaataacaaataaataatggatgaattaaacaatggggaacaagggcaatatgtcgaacccgggaaaaatgagaagaaaaataatacacgaaaaattgtaaaaagaactttgattacggcaggactagctttggctgtatacatggtatactccatcgtttatctgtttatttcgcccgaccgtaatattcagcagatctatctggtgccagaggatgcagcgtttatcattcagtcatctgctccgatagaagactgggaaaagtttagtggaagcgaaacctggcaatgtctgagaaaagcgaaatcatttgaagaagttgcgaagagcgtggaaaagcttgactcggttgtcaaaagcaataaagtactgttatcactggtcggtcagcgggatctgcttatctcacttcataagacccgcgctaccgattgggattttctgcttatagtagatatgcagaaagcttctaaaatggatttattgaaggatcaggtcgaaacagtgctggcaatgtccggctttaccgtcactaatcgaatgcataatggaattaacattcttgaaatgcgtgatccggatacccgtgatgtcttttatactgcttttgtggataatcacctggtaggctcttatacttccggccttgttgaatctgccatcaactcccgtaataagcctaagatcggacttgaccagtcttttattgaaacggaaaaattagtttccggtaaagggcttgtcagggtatttatcaactatgcccgtattcctcagtttatgtccatttatctgggagcgagaaatgaatatgtcgatctgttcagtaattctatgaattttgcgggcctttacctgaatatggataaggaccggatggaagtgaaaggttatacgttgaagaaagattcggtggatccttatatcactgccttgctgaattcgggaaagcataaaatgaaagctcacgagattttgtccgggcgaacggctctttatacaaatatcggcttcgatagtccggtaactttcgtgaaggaactagagaacgctctgtctgttcatgataaactgttgtatgactcttatcagagttcgcggaaaaagatagaaagcctgtttggtatttctctggaagagaacttcctgagctggatgtccggagagtttgccataacgcaatccgaaccgggcttattaggacatgatcctgaagtgattctggctattcgggcaaaaagcatcaaagacgcccgtaagaatatggagtttattgaaaagaagatcaaacgccggtctccggttaagataaagtctgttaattataaggactttgaaatcaattatgttgaaatgaaaggtttcttccgtctgttcttcggaaagctgtttgataaatttgagaagccatattatacttatgtggatgattatgtcgttttcagcaataaaccggcttccttgctttcctttgtagaagattacgaacagaagaatttactgaagaataatgcaggatttaaggatgcttattcgtatatgaaatcaagttccacaatcttcttgtatacagatatgcacaagttctactcacaattgaaacctatgatgaatcccgctacatggaatgaaatacaatcgaataaagatatcttgtattcatttccttactggacgatgcaggtaatcggagataacaaccaagcttctctgcagtatgtgatggattaccgtccgtacgagccggaagaggtggtggccgttgtcagcgatgaggaagatcaggatatggatgaagaagctgtgaccgaaaaggagcagatgagtgagttaaagcgtttctatattgagaagtttgaaggaaatgttctgcgtgagttctatccggaaggagcattgaaaagcgaagcggaagtgaaagagggaaaacgtcacggacgttaccgtgaatatcacgaaaatggaaagctcaagcttcgtgggaaatattcaaataatcagcctaaaggcacatggaagtattacaccgaagaaggtgaatttgaacggaaggagaagttttaaatgaacttctcctgattggatatatatcttatttaatattttcttctgtgctgggacaagaagttatctataaagcggacgatataaacgacagcaactccggctatgaccaatacgataatacgactcaacatagtttttgattttatatttgacaggcacaaagataaataagatatatgatatatgggatatcgggataagaaaaaataattcaaccctagaacagggttctgaatagtacttttataaattgctgatttctagctataaagaaaaatatgaataaaaaagtgtcgaaaagtttttgagttctcgcaaaaagcactacctttgcatccgcaaataaggatggttccgtagctcagctggatagagcaacgcccttctaaggcgtgggtcaagcgttcgaatcgcttcggaatcactgatgtaaacgttgattatttaataatagtcaacgtttttcttttgtttggggtacatcaattttattgaattctgagtggtttcatattgcgattatcccctataaaacagtaaatgtccccctatgtccccctttgctgtatactatattgatttgataaacaggcaaatatttgatttaattaagaatatatttataccccctattttataaagcaactcccattattattcctacatttgcattcagagattcgtctctttagttgggaaacataaaccttttgttcatgaagcatttacgacaaactgtactttttatattgttaggattcttattgactgcttgtcatcatacagccgaccgattgttatctatcgaacaattgatcaagctgaaaccggacagcgctctttctttacttcgccaaattcagtatccggagaagctgtcggattcaaatagggctttgtatgcattgctaatgactcaggtgatcaatcagtcatctgatgaggagcataaaagtgattcacttatatctgttgcaattgattattataaaggaaccacggactctgttcatgcggcactggcttattataatgccggtctggtagcaatggataatgaagattcggaagcttccctgcataatttcctaaagacaatcgattggttgggagagagtgataacgatgaacttcagttcatggtcaggtataaaatgagtcgtcttttcaacttgcgactgattcctgatgaggaactacggttggggaaggcagcgttaccttatgccgaacggacaggcaaccctttgtatatctgtgcactgttgccgtatatcactcacggatttatgcagacaaatcaactggatagcgcctataaatattctgtgcaagcgatacaactggctgagaaagagaacttggtccgggcattatcacatatttattcacagcatgcccatctttgcatggcgatgaaggactataaacaggcgttgatgtatcgcgataaagatttggctattctatttgaacttttcggagaggaaaatgaatatatctatgatcattatataaataaggcaaacacactgactgaactgcatcagtatgattctgctttctactacattaataaagcggtggaagatacaacagatatacaatatacaactcgaaagtctttggctaaggctgaaatttatgctgctaccgggcagatggattcggcatattattatatgaaccgacatgctgacttgcgggataggctcatagaggagagagataaggaaggcttactgactttgcaccggaattatcacaatgatgaattgaaaaaagctaatacccgtctctggcaacaggcggtagaaaggaagctgcaactgtatgttgtgactattgtttgttgcctggcgattttgttaggggggtgcatctacttctttttatataaaaggaaacaacaggaagtattgcgtcagaaaggacagattgctcatcagcaggagttgttgaagtaccgtgaaatagaaaaactacaggcagaaaaagacttgtcggaagctaaggaaagggaagcgcagattcgggagaaagaggctttactaaaggttgagttctttaagcgcctgaatgaaacttgtattcctgtgattgaaaatccgaagacccagcagaatataatgctcaagaatgaggactggaaagtaatattcaagaatgccaacagtatcttcctgaattttacagaacgtctgaagaatcagtatcctgcactgaatgaggaggatttgcggtattgctgtatggtgaaaatgcagttttcgcagactgatattgctaagatcatgcatctggagaaagattcggtgaagaaaagactgaaaagaattcgtaccgaaaagatggggatagcgcaggaaacgacattggaggctgtgcttcgggacttttaaatgattaagaatgagaatgaaataatttgttaaaccaaacattagaattatgaaacaaacactgagttttcatagtccgatcattgcttctacacagagcaaggtggatgtagaagcttttgagaagagtacagatgcttttgaaaagggagagcacttacagtctttttatctgttgctggattatattgatccggagttacgcagcaaatttggtaatgcggaaggaacggagtttgctgtgcctcatggttccattatggtctatctgaagctggagggtgaccaactgaatattacagctccgtttttgttgctgccggaaaagggaaggatacctttgctgcggcaggtggcagctttgaatctgacagaactgacattagcatgtatctctttgcagaatgataagttgttctttgactttcattgtccggtggctttatgtaatccttacaagatatactatgtgcttgaggaaatttgccggataggagataaatatgatgatgaatttgtgactaagttcaaggccgagcgtatttatgaacccaaaattactccatacgatgatgaaacggtagataaggtatacgaagctcttcagcagacctgcaaggaatgtatggacgctgtaaaatactttgagacagaacgaaagtatggttatgcctggaatatattatccagtacgcttcttaaaatatgctattttgtctgtccgcaggggcaactgctgaatgatcttgataaagcgattacagatcacggacgcgaggatatgccattgccggagatcgtatcccgtaccaaatctgttgtcacacgccttcaggaaatgacgaaggagcaactggctgccgatctttactttgttgaaactttcatttcggacagacgccgttccgtactgaaaaacattcaggataactttgaagatacatacgagaaagctggctcggcattggaatcaggtgacttcatcgtttgctgcttgcttattattaataagttctatgaattgtactattataataatgtgcagaatgatgtgaatgcggtagttgcgaaagctatgaaggctacctctgccatgtcatgggaagaagctgctccgatattatatgaagcgatggacaatatcatggaaggagaactggatgtagatgatgacgaagaaggtggtgacgaagacggagaaataatgggcttcgacatgtcacaactacaacagatgcaacaggaaatgatgcagcaggcgatgcagaatatcgatatggagcaaatacagaagatgcagcaacttgctatggagaatatgcaaaagatgatggccggtatgtatggcaacaataacaatacggaagaggacactaacaaataaagaacaagactatggaacagaatatatacaatgccatttataaagtgaatcatgccggtggctgcggcagttgtttttatctgaaacaatatgatctgtttgttaccaattatcatgtagtagagggattccgtcaggtagcgatccaggataatgataagaattcgtttctggccagggtcgttatggtaaattccgtattggatattgctttgctgtcggtggaagggggtttttctgctcttccggatatccggttatcggagttgaaagaagtcgcgatcggacagaagataaacgtggccggctatccgtttggtatgccgttcacagtgactgaaggtacggtttcttctcccagacagctgattaacaacagttattatattcagacagatgctgcggtcaatccgggaaatagcggaggtcccatgttcaatgaacgtggtgaattgatcgccattaccgccagtaagatcaccgatgcggataatatgggatttggtatccctgtggatacactgaaaaaggtactggagaatatagaaagtctggaccgctctgtttttaatgtgcagtgtaatagttgcgatgaattcatttccgaagaagatgaatattgcccttgttgcggtgacaagttgccggaagaaatctttaaagagaggggactgaccgatctggctgtattctgcgaagaagccattgaagcgatgggaatcaatccggtattggcacgtgtgggatatgaaggctggaaattctataagggaagttcggagatacgtatgtttgtgtacgaccgttcttatttgtttgccacctctccgctgaatattctgccaaaaaagaatctggaacctgtgctgacctatttacttcagacagagattgctccttatcgtttcggactggatggaaatcagatttatctttcttatcgtgtgcatatatctgatatattctccgattattcggaaaatgtcaagacgaatctgacccatctggctttcaaggcagatgatctggataattatctggtggatacttttggctgtgagttttccgaatatgctaataaaaacgctatctgaccaataactaaactatttgaatatcactcctttcgctgaatcattgaggcggaaggagtgtcttttttcctccctgccggacactcgcaaatctatttttacgaagaataacgaacgttatataggtttcaaaaagctcaaaaaaggtaaaatgatgttgcgattctctgttattacttatacttttggacgattaacaactaaaaaacacaataaagttatgaagaaattgatttttttatttgcattttgccttactgtgactaacattttcgctcaaactgaccctagccaattgaaaaaagaaggaagcgacgcttttaatgccaagaactatcccgtagcttatgctaaattcagtgagtatctgaaacaaacgaataaccaggattctgcaatcgcttattactgtggtatggctgcagatgaagtgaaaaagtatgcagaagctgtgactttctttgatattgctattcaaaagaaattcaatataggtaatgcttatgcccgtaaagcgctggcactggatgctatgaagaagactgacgagtatgttgctaccttggaagaaggtctgaaagtagacccggacaataaaacaatgattaagaactatggtctccactacctgaaagcaggtattgctgcgcagaaagccggaaaagctgaagaagcagaagaatgctttaagaaagtgattcctttggatcataaaacatataaaaccaatgctttgtatagcctgggcgttttatgctataacgacggtgcgaatatcctgaaaaaggctgctcctctggcaaactctgatgcagacaaatatgctgcagaaaaggaaaaggcagatggcagatttaaagaagctataggttacttggaagaagctaccaaagtttctccggaagatacaaagtctaaaactatgctttctcaagtgcaagcagctatgaagtaaactaccaattccagatagaaagggttgccggggaacattttggcaacccttttttattgcttttttttttgaatgatctactttttgcgtacttttgctttcccaaaaagaaagactttatgcaattatatacaagagaagaaacgattcggaaaataaaccatttagggcaatcctgccggccttttatttttattattaattatttgcaggatgcatcttatatagaagaagttgcctctgttgacccttctgaagtagtatataacctgaatgggtttaccaaccaatcttcatcgaaggatgtgctttcttgttttgaagaacctgtccactggaattcttatcccgaatctttcgatagttaccgtcggtcatttgatatcgttcaacggaatatatttgccggaaacagctttctgaccaatctgacatgccgcacgccgatagagacgaaccttagtctgaaagatattttcttccgttcaaaagcaatgtataaattgtgggtcagggatcagttcacagttttctctcccgagatatttgtcagaatccaacagggaaaaatcagttcttatccgatgaaaggtactcttgatgcatcattgccttcggctgtccggcaactgatggatgatccgaaagaggctgccgaacatgctactatcgtagatttgatccgcaatgatttaagcatagtggccgatcgggtatctgtgtcccgatacaggtatattgataagttgcagacgaatcgcggaactattcttcagacgagttctgaaatacagggaaccttgccggataattatcgggaaaatctgggacacattcttttcaaactcttgcctgccggttctatcaccggtgctcccaagaaaaagacgatgcagattatcagtgaagccgagacgtatgagagaggattctatacgggtgtgatggggtatttcgacggaagtagccttgatagtgccgttatgatacgttttgtggagcaggaaggcgacagaatgtattttaagagcggaggtggaataacctgccgtagtgaagtggaaagtgaatatcatgaaatgaaacaaaaagtatatgtgccaatttattgaaacgattcgcatagaagacggacaggtttataatctgtcgtatcacacagcgcgcatgaaccggactcgtgccgctttttggaaagaagcggctcccattgatttgtccggctttatatctcctccgtctctgtccggtatctggaagtgccggattgtgtacggtaaggaaatcgaagaggtcggatacactccttatcaaatgagaatggtttcttccttgcgtccggttgcttcggacactattgattatagttacaagagtaccaatcgggaagaattgaatgatctgtttgcccggagagggaaggcagacgatattctgatagtgaaagacggatatctgactgatacctccattgccaacatagcgctgtatgacggacatacatggtatactccggctcatcccttgcttcaggggacgaagcgtgcggaactgttggataatcggttcatagtggagaaagatatccggcaggcgcaattgggcgattactcccatatcatgttgttcaatgcgatgatagactggaaacggctcatcatacctgtcaatgaaaaatattttattctataactaaaattaacggaaatatatacagaaccgttgaacaaagcctctttttaatctgttatatttatgtgtttttcatagtattagataaagattaattaaaagagattgtacttcacttgtgaaagcttagagtacatcagaagcagaagagtctgtttttttgataaatgtgttagagcatcggttttaccaggccgatgctttttttatgtccttttgttgcgttttgtagtttatatgaaataaaatttgtacgtttgtagggtaataatagaaaatgatgaagatgaacatacccgttatctttcagtttttaaaagatctttctgcgaataataatcgtgagtggttcaatgagcatcggtcagaatatgaagtagcccgtgccgagtttgataactttctggcaacagtaatcgcccgcatttctttgttcgatgaaacaatccggggaatccagcccaaagattgtacctatcgtatttatcgggatacccgcttctctgcggataagacaccctataagatacattttggcggttatatcaatgccaaaggcaagaagtccgatcattgcggatactatgtgcatctgcagcctgacggaagtatgcttgccggaggaagcttgtgtttgcctcccaatgtactgaaagctgtccgccaagccatttatgacaatgtggaagagtatatctccattgtagaagaccccgaattcaaaaaatattttcctgtagtgggagaggacttcatgaaaacagctcccaagggattcccgaaagattttaaatatattgattatctgaagtgcagacagtttgtctgttcttatcttgttcccgatgattttttcactcgggcagacacgatggagcagatagagaaagcattccgacagttcaagagatttgccgatttcatcaattacacaattgatgattttgaataaaataatacctaaaaatataaacttaaaaattaaactcatatggtagtagatactttagaaaatctggaaaaatacgcgtctttgaatcctttgtttgcacaagctattgagttcttgaaatctcatgacctccaagccatggaaataggcaagactgaactgaaaggaaaagatctgctagtgaatatcgcacagacaaagcctaagactaaggaagaggcgaaattggaaacgcataatgaatttattgatattcagatcccattgtcgggaacagaagtgatggggtatactgctgccaaagattgtgtgcctgccgacactccttataatgtcgaaaaagatattactttctttgaaggactggcagagacatacgtagccgtgaaaccgggaatgtttgccatcttctttccgcaagacggacatgctcccggcattactcctgacggagtgaagaaagtgatcgtaaaagtaaaagcataaacctaattcaattctgatatgaaggagacactcaacattatcaaaaacgatccctggctggaacctttcgcagatgccattaccggtcgtcaccagtatgcactgaacaaggaagccgaactgaccaataaaggaaaacaaactctttcggactttgcatcaggctatctttattttggtctgcaccgtactcccaaaggatggacgttccgcgaatgggcaccgaatgctactcatatttatatggtaggtacattcaacaactgggaagagaaagctgcttataagctgaaaaaactgaaaaacggtaattgggagatcaatcttcctgcagatgccattcagcacggagacttatataagttgaatgtgtattgggatggcggacaaggtgaacgcattcctgcatgggctacacgtgtggtgcaggacgagcagaccaagatattcagcgcacaagtctgggcaccggaaaagccatataaattcaagaaaaagacatttaagcctactacgaatcctttgttgatctatgaatgtcatattggaatggcacaacaggaggaaaaagtaggcacatacaatgaattccgcgaaaaaacacttccacgcatagcacaggaaggctataactgtattcagattatggccattcaggagcatccttattatggtagttttggctatcatgtatccagtttctttgctgcttcctcccgctttggtacgcctgacgaactgaaagcgctgattgatgctgctcatgagatggggattgccgttattatggatattgtccattctcatgcggtgaaaaacgaagtggaaggtttgggcaactttgccggtgatccgaaccagtatttctatccggctcctcggcgtgagcatccggcatgggattcactatgctttgattatggcaaaaatgaagtgatccatttcttattgtccaactgtaaatactggctggaagaatataagtttgacggattccgttttgacggtgtgacgtctatgttgtattatagccacgggttgggagaagcattctgtaattatggagattacttcaatggtcatcaggacggcaatgccatttgctacctgacattggcgaatgagttgattcatcaggtcaatccgaaggctatctctattgctgaagaagtttccggtatgccgggacttgcggccaaagtagaagatggcggttacggatttgattaccgtatggctatgaacatccctgattactggatcaagactatcaaggaaaagattgacgaggactggaagccttccagtatgttctgggaagtaaccaaccgtcgacaggatgaaaagacgatctcttatgcggaaagtcatgatcaggcattggtaggagacaagactattattttccgtctgattgatgcagatatgtattggcatatgcagaaaggcgatgagaattatgtagtcaatcgcggaatcgctttacataagatgatccgcttgctgacatcttcgacgatcaatggcggttatctgaactttatgggtaatgagttcgggcatcccgaatggatcgattttccgcgtgaaggtaatggatggtcttgtaagtatgcccgtcgtcagtgggatctggtagataacaagaatctggcttatcactacatgggggactttgatgctgagatgctgaaagtgatcaagagtgtgaaagatttccaggcgactccggtccaggagatctggcataatgatggtgatcaggtattggcttatggacgtaaggatctgatatttgtatttaacttcaatccgaaacagtcttttgtagattatggtttcctcgttagtccgggagcttatgaagtaatcttgaatacggataatgttgcatttggcggaaatggtcttgcagatgattcagtagttcatttcacgattgccgatccgttgtataagaaggaaaagaaagagtggctgaaactctatattcctgcacgtacagctgttgttttgagaaagaagaaataactcagggaataaaaaataagaaagcccttgccgagcatttaatgtttggcaagggctttttttataagaatgttcccggaccgagaatgtcgtacatataactgacattgcgggtttttagcaacattccttgcggggaataaaagagctggtatttgatatctacattatcttgtcctaccttaatgacgatgattgcctgccatttaggaaactccaccatggttacatcatttactacccaactggcataaggaccggatacaaaggcattgtatacggtaggtgtcacccggtcgagactgacaaggtccgtctgtgtcatttgccattgagcctgcgtattgaaccagacgtttttagtgaatccattcataacaaagttagcgcaataatagccatcatcctgcgaccatgctataccgttggctttggggtacatctttttgaaggcagcctgtatattgccgggaggtaagattgcgaaggcagatacagacaataataatatgactgccaaaaaactaattttcttcataaggttctggtttaggaaattatttatctaactaaacagcctttgagaatttttgttttcagttggggagaataaatcagtagtatctccattggggctgcctaaaaagtcaatagtatcatcaattcccctcccttcgggaaggaggagagttaagatactattgatttatcatttgccttcaatcggagcagatcagaatgtaatcttcagaatcttcccattataggctccaacggaaacctcagtggctttataaggcaataaacagatttcctctttggcaccggtcaataagtctgtagcctgatatttttccatttgtggtatctgtaagaaatcaaacgcgtgagaaggtacgttgattgctacatcaaccagttggctatcgaaattgacgatgatgaacagcaattcattcttatactttcgcataaaagtatattgcttatgttcgtcgaaacgccatccgtttttattggcgtacatcaggtcgaagaatactcctttggcgatggatgtctcttcattacatagcgtcagtactctttggtaaatgctgtacaggcgtttatgctcttcggtcagcattttgccgtcaaacttaccgccattgcgccagcgacgaatagtatccacgctccagtaatcgaatatcgtagtccgtccgtctcttccgctgaaaccttcgctgtccattcccagttcgccgaactcctgaccaaaataaatcatcataggattggtgttcatacaagcagaaacgatcagagcggggattcctttacgtggatctcctgcaaagaaatcggaagcgatgcgctgttcgtcatggttctccaggaagttcagcatttgcttttctattccgttcagactttgccagcagtgagtgatggatgcagcggattcgtagccgcaagctacattgcggagtgtatcatataaaccgaccttatcatatagatagtcaaatttcccacggaagagataattgcggtattcgttgggattatagacctcggcaatgaaaagaatttccggatgcgcttcctttacttgtggaatagcccattcccaaaattctactggaaccatttccgccatatcgcagcggaaaccgtcgataccttttgaggcccagaataaaagaatgtccagcatctttatccaggtatccggagtcggcgagaaatggcaagtgccgccattcagataatctactccatagttcagcttgatggtttcgtaccagtcgttgatgttcggtgtagcgtcaaaacggttgttacctgtcgctttggccggatattcgtggtaaggttccgctgcaccttctttcatgtcgaactgggcacgcaactcggactgcggtatatagtagaaattattgtacgggctgaaagcgtagttcgggtcatcgtttgctcccagttcggtagtgccgtccggttgtgcatccgagtgatactggcgtgctacatggttggggacaaaatctataataactttcagtccggaacggtgagtgcgatgtaccagattctcgaactccctcattcgttccggcacatcggttgccaagtccggatctacatcataataatccttgatggcgtagggagagcccgctttacctttcacgatggcggggtggtcgggacgtatgttgaagcgacggtaatccgtctccgttgcatgctcgataatgcctgtataccagatatgggtagcacccagtttcctgatttctccaagtgccttgagggtgaagtcggccattttaccacatccgttggcggtaatgtctccattgtagacacaatggttgttattgtttccgaacaggcgtgtaaacacctgatagataatcattttattttcgttgttcatatagagtagattttatttcatatcataaatgttttcgcgaaaagtaaggtattacttccatattttccctttttccgccagtgtctggtcaagtaagtcattggctatcttataaccttgctcgaagatttcttccgctttttccagttcggtgttgctatatccatagagattgtatggctcgatcagcaagtcacatttttctctttcggggaaagtattggcacggaacataaagtggaaggagcgcatggcaatgcttacgatattcattttatagtcttgcgccatgatgggacttacgttgacggctaccaccttgtcgcatattctgcgaagggtggagaccggaaggttcatcattaatccgccatctacgtaattggttccgtcgatattgaccggagcaaacatgacaggcatacagcaggaagcggccacacgttcggctatggagccacggtggaaatgaaccatacgtccgtggtccagatcggtagccgtgatgattaaggggatttgcaactcttccagattcttggctttcagattggtatggagaaagtcaataaattcacagaggtcaaatagtcctttcttggggatgactaactttgtcaggtcctgaaacttatggccggagaagtattcaatcacttggtgaggttcatttccgtcggcataaaaaactccggcaagcgcaccggcacttactccggagataatgtccggtttgatatcatgctccagcagagcctgcatcacccccaaatgcgcaaatcctttaataaatcctccgcttaaagcatagcctatctgatatttacggctattccagttatttgtgaatacctccatgagttactttctttttttagttcgccacgaatttagtgaatttattgaaagtaggaggaatataatggatagtttttttgaattgtatacaatcctctgaaagctatccatatttggggctgatgctgctagaatccgaaatcgtctatctcaactttatgttcttctgattctttgaaaggtttcgcttctttctgcacagggtttccttcgatatatacggcacggaacgggcgggcagggcagacgtattcgcagccgccacatccgacgcagatctctgtattgacgtggggaagagtcagtccgtctttgtagggtaccatagcaatggcttgcgtaggacaatgctctgaacaggctccgcaactggttccgtcagtgaggacaatgcaattttcttctataaagacgacatagcccatctgagtgagatgtttctgttctaccgtcaacggagggatggcaccgttgggacagacatcgctgcatacggtacagtcgaaattacagaatcctttttcgaaactgaccgttggctgcatcacacctcccagaccgtattccatgaaagcgggtttcagtacatgcgacgggcatttgctgacacaaagatggcatgatgtacaatgttgctggaaacgcttctggctgacagatcccggaggagtaatcggattttcttttttgtatgcctttttgccttccatcgtcgcaatggattcttgcgcctttgtaagaagcgtgggagctgctccggcagtagccagtccggcaagcagaaaacgacgtttggaagaatctgcagcaacggaagatgattctgttgccaccggttgtttttctgtagcggaagaacgttgttgtccctttgaagcaggggcgtaaaccagcgctttctgtttgcaggcaccgagacagtcgaaacagtctacacagcggctatagtcaatagcgtgttctttgctgtggatgcaggcagctttgcatttggtagcgcaaagtccgcaaccattacattttgcggtatcgatacggactttgaacaaagagtaacggctcaaaaatcctaataccgtacctaccggacaaatggtattacaccacgtgcgtccatgtttccatgctaatataagaatggcggcaaaggtcagtatcgctataagaagggaagaaaggcttaataccgaggtgtctacctgataaaacgtgtagttgtcgaatctggaaaatacggattccagcaggttgtttcccagcatatacaccggtttgaagatatgtactacaatgcgtccgtatgcgctatacgggtccagcaatcccaataccactgagaagccgcatacggaggcaattacagtcactccgagcacggtccatctcagcatattctttgcaggactgtaccgatatctttttttcttctttcccacagactttgaaatgcgtgctataacatcctgccatattcccatcggacagatggtagagcaatagatacgtccgaacaacagggttaacgcaatcagcacaatcagtatgcctatgctgagagatagcacggcagggacaaactgtatatgtgccaatcgatgaaaactgttcggcagaatattagcaaaatcgagaaaataaaaagtaatcagtgcaaaaaggacgactgatattccgatacgtatctttcttaacatggtggtttacatcttaattcgcttgacattcagtttgtcgatgtccatcgttcctactttcagtgcttctcctttggcaaggtgacctacggtgtccagcggcatttcgcgtatctgattgaagaatttggctgcggctgtatctacggctacaatatccggtgaaataaagagaccttttgccagcaccacgtccgaagcggaacgacctcgcggtccgttggtcttcatgatacggtaggcgtctacgacgttaagcactgctttcttttccagtgtgcagatgtccgcaatgcattgctgcaagtcattctggtggaaaaagccgcggtcccagacgatacccatatggtttttcatggagatagtcaggttggcgcctccgtgattcttcaggatagggacgttaatccatacatcacaattcaggatggcttcatgtattttcgccttcttcatcttttgtccctttggcagatcaacgggtttgtagtaagattccaggtgggccggcataactttggctccggcttctttcgcggccgcttcgataccgctgtttttgtagcacttctgccaatcgtcgcaggtatggtcgaatacggtgacctctttggctccggcggcaaaacattgtttgatgatttccgtgatcagtttcggattcgtgtttcctgccagttcgggtactttatcccatccgatattgggctttaccactactttctgtccgggtttgatgaattgcttcataccgcccagctcgctgatagcacgacggaacatggcttccggttcaccgcccatgacggccaccaggtccggtttgtcaccatttgctttattgattgtctgagtcagtatttccatcgcctctgaacgctgtatagtcatggcggcaccagtaatagctactgtcttaaaaaaatcccttctgtccatctttcttttttagtttagagttttgcaattgcctttagcagggcgtatccgccaaaccattgaatgagcatacccggaatgccgatacggaagtcttgtactgcgatatagaaatctccctcgatcatccattcaaaagcggttcctatgagttgataggagagaattactccaaggacggctaacaaagaaacggttttcacggtacgcgcagcaagggcggaagcaccggcaagcaaggttgattttatcagtataatcgggagaacggcttcggatggcatggcaaacaagacatgattgatgacaggagaaagaacagctgtcagcaatcctacccgaaagccgtatttataagcggcaattaaggtaaaaaagtaaattggtaataaagtcggtccaccgtaaggaacgaggtggcacagttgtggaagtgcgatgttgcctgctacgaataacagggcgaacaggtaagttttcacattgctgtaattcagcgaatagagtttggcggatgtttccattttcattgatgactttaatgtttagattgatgatatcttaaagattagactattctcgtttgaaaaagtttaatcggtctcataatttcttggccggtcaaatcatgattgggctttgatgtttacaaaagtagtacaaattttcaatgaaacgtattattttatcgctttttgtttattcattgaagtgcgtgaaccggaacagtggatttctccttccggtgacaatgaaaaaaatgtatgatttatgaatcatcggtgtttgtgtttataataaactttgtgatagttttagtaaaacggtatctgagtttattataaacgatgtaatcccgtttatggctttctgtgctgaaatttggcaacaaaaaaggctgcgatttccattggaagtcgcagccttcagcttgtatactgatgactcatatcttatttgttatagggaaatagatatgtcttgttgtaatattgtactttccttacggactgatcaatcttgactgtatgttaccgttcatgtgatacattacagcaggtatgttgaaagacagacttcttttcattggttacggttttataggtttattattgtgttatgtaggtcagcggcgtttccgccgctttccccattaagaactgtacgtgcttgtaacagccgaagccatccttaaccgcttcacaaacaaactggaaatccgtggcgctgtctatcgtcccggtatctaccagctcagcggtaaactgaatacgatccgcgaacttgtccatgaagcccagggcctgaccggtgacgcttttctgaatcgtgccgtcctttatcgccagcgtgaggatttgaccagtgaagttgttcagatagacatcaagtctatcatggacggtacttccccgaacctcgccctgatgaagaatgacatcctttacattccgagcattcacgatctggaagatcgtggcaatgtcacagttcacggtgaggtcgcgcaccctgattcctatccctatgctgataacatgacacttgaggatctgattattcaggccggtggcttgaaagaagccgcctctactgtccgcattgatgtgtcgagacgaatcaagaatccccgtagtaccgcggataatgatactatcggtcagatgtataccttttctttaaaggatggttttgtcatcgacggtcagcccggttttatccttcagccttatgatgaagtttatgtccgtcgcagtccgggttatcaggcacaacagaatgtagtcattgatggtgaaatccttttcggaggaaattatgccatgaccaaccgtgaggaacgtctttccgatctggtgaataaagcgggtggtcctaccagtcttgcctatcttcgtggtgcaaagctgacccgtgtggcaagtgccggtgagaagaaacgtatgggtgatgtgattcgcctgatgagcagacaattgggagaggccatgattgactctttgggtattggtgttgaggatacctttacggtaggcattgatctggagaaggctttgactaatcctaagggtagtgccgaccttgtcttacgtgaaggtgatgtggtcttcataccaaagaataataatactgtgactatcaatggtgctgtcatggttccgaatacggtttcttatatgaagggcaagaatgtggattattacctgaatcaggccggtggttattctgataatgcaaggaagagtaagaaattcattgtttatatgaatggtcaggtgacgaaggttaagggaagtggtaagaaacagattgagccggggtgtgagattattgtgcctagtaaggctaagaagaaagggaacatagctaatattttgggttatgctacttccttcagttctttgggaatgatgattgcttctattgccaacttgataaaaaaatgacatataatattatgactgaaaaccaacaatacagaaagcctcaaacagaacttgatgattttaaagacagtgaaatagaaattgatttattagaaatttttcgtaaaataattggtgttcgtaagactttatgtaaagctgcaggaataggatttattattggtgttattgtatcattaagtatctctaagcaatatacagtaaaggtaactctttctcctgaaatgggagtttctaaagggaatagtggaatagcaggacttgcagcatcttttttgggtaatgatgttaccggtggaaatgtttctgatgcattaaatgcttctcttgctgcagagattgtttcttctactccttttttacttgagcttctcaaaaagaatgtgcctgatagtaataatgttatgaaaattactttggaaacatatttggatgaacagtcaatttcttggtgggattatgttctaggttttcctggtataatagttaattgggtaagatctttatttgtagatgaagaaactaataatggaataaagttaaacgtgattcaattaactaaagaagaagctagaagaatagcttttcttaaaaagaatataactgcttctatggataagaaaactgcaattactgaaatactggttactttgcaggacccgaaggttgctgctatagttgctaattttgttgtttatcaattacaagactatattatcaattaccgtacttctaaagcaaaagaagattgtatatatttggagaagttatataaagatcgtcgattggaatattatgttgcgcaaaagaaatacgcagattatgtagatacccatgataaccttattcttcaaagtgtacgttctgaacaggaacgattgcaaaatgatatggcattagcatatcaaatctatagtcaagtagctaatcaattacaagtagcaagagcaaaagtgcaggaagagaaacctgtatttgccatagtggaaccagcggtagttcctttaaaatcttctaatcttggtatgaagatatatgttttattatttgtttttttagctataattagtgctattggctggactttttggggaaaaggattttggagtagttttagaaatgagtaaacaatgaacattctatttatattcatatccttttgtatttctgcttgtattgctagacttataattccacgcattttgatgatttcgttccataaacgattgtttgatatgcctgacgaacgtaaagtacacaagcgtgctattcctcgcttagggggggtggctttctttcctactatccttctgtcgtgttgtgcagttttggcatttcgggcattgtcaggatataacatttcatttgagcagtctgcatacattttgcctgaatgtatgcttttagtttgtggcatgattcttctttatttaacggggattgcggatgatttaataggagttcgttatcgtcaaaagctagtcattcagataatttgtgcgtgttttttccctattgctggtctttggataaatgaactttatggattgtttggtattcatgctctttctgcttggattggtataccttttacagtattgacagtcgtatttattaccaatgcaattaatttgatagatggtattgatgggcttgcttctggactaagtattgttgctcttcttgtatttggatttttatttatggataagaatttatgggcgtatagcatgttggctttcagtactttcggtgtccttattccttttttctattataatgtttttggcagtgcggaacgcgctcgtaagatatttatgggagatactggcagtctaacattaggctatattttgagctttttagctattaagtatagtcaaaacaatccagtagttataccatatacagaaggagcttttgtgcttgcctttagtactttgataattccggcctttgatgtgattcgggttgtgatggttcgtattcgtaatggtaagagtccttttgaacctgataagaaccatatacatcataaatttttagcaatgggttttactcctagaaaggcgatgattactatattgttgatttcttgtggatttagtgttataaatataattttgatgccttatattgataatacagtgatgttaataggtgacatcgttttatggataggattgaatttgtggtgggatagagtgagagatactattttaaaatagcttttttaaaaaacaagattgttctacattgatgaataataactctctaaataataaacgaatagcaaaaaatacattaatgctttatattcgtatgctgcttactttgggagttagcctttatacgagtcgagttgttttacaagtattgggtgtagaagattatggtatatacaatgttgtaggaggtgttattgtattattctcttttttgaatggagcattaacacaagctactcagcgttttcttacgtatgaacttggacaacataatataaaaagatttaaacaagtcttttgtattagtctgttggtgtatttgggtttatcgaccataattatatttcttggtgaaactcttggtctatggtttttaaatactcatttaaatataagtgaagacaaaattgtagctgcaaattgggtgtaccaatttactattattacatttttcttaaatatgatgtgtaccccttacaatgcggctataatagctcatgagaagatgtcattttatgcatatatttcaatagtggaagtggtgttaaaattgctagtagtatatctattaatattggtcgattgtgataaattagcaacttatgctgttttgatttctttagtggccttgattgttttgttactttatgttgtttactgtgtttatcaatttagtgaatgtaaatattcttattactgggaaaaacaattgtttgtaaaattgataagtttttctggctggagtatgtttgggagtatttctgtattagcgactaaccaagggataaacatacttttgaatattttttttggagtaatagtaaatgctgctatggggataacgaatcaggttagcaatgctattaatcagcttgtggtgaatttccaaatggcatttaaccctcaaataaccaaatcttatgctaagggtgatagagaatattgggaaacacttgtgtttcaatcagctaaggtctcttatttgttgttacttttagtctctttaccatttttaatgcaaactaaggtaattttacatatttggcttgaaaaagttccacaatatactgtagaattttgccagttaacaataatagccctactaatagatacactttctggacctctttggatgcttatgcaggctaatgggagaataaaaaagtatcaattaattgtcagttctatttttctactaaactttattttatcgtatctgttaatttcttttggatgtagtcctgtttctgtattaattgtacgttgcataatgtgttgcttattattgacagtcaggttattactgtttgtatcaatactaaacttcccttctgcaaaattttgcagagaggtaattttgagagttgttctagtaacattaatagcgttgcctttacctgtgtttgtaagtatatgtaccgatggattaaacggtttaattattactaccattacatctttgttatcaatattcttttttttctatttaatgggattgagtgttaatgaaaagaaaaaattaaagagctatatctataataagatgaaataataatagaatcataataatatccatagaattagtatttaaataggggtataaaagtagagctgagtctgaatgtctaaataattattgtaatataaatgtgttttgaagaaaaaataaatgaacttcgtttgaaaattgatgaagcattacttccattgattaattatgactatatattatgtgaactgccttatcatagaaatataggtgacctattaatatgggaaggtgaattacatttcttaagaaagagtcaatataagatgttaaattatagttctatgttaacatatagatatcgaagattgtcttctaaaactattattctgttacatggtggagggaattttggagatatatggagaagctctcaagattttaggcttgaaatgatacaacgctattctaataatcggataattatatttccgcaaacagtgtattatcaaaataaaagtttaatgtatgaagatgccgctattatggccgaacatcctgatttaacgatttgtgcacgtgataaggaatcttatagagtattaagaaagcactttaaaaataatattcttcttgttcctgatatggcattttgtataccttatgaggatttaagtggatatttattgaatgaaacatatgaaacattattcttaaaaagaactgattcagagttaatgaaaaatgcgatattttttgaagcaaaatatccattaataacatcggattggccaacttttgagaaaaaaacattgtttgatataggattgagtctttttttaagactgcgtgtatttaaattattttctttgattaattggtacttttgctctgtatatagacctaatgtgattaaaatgggagtacgttttgttagtcgatataaagaaatttatactactcgcttgcatgtcgctattttggccgtattattacataagcctgtttcattagttgataattcatatggtaagaatagctctttttacgatacgtggctatcagatttaaattttgttgattttgttagataaaaaatgaatccgaaagtctcaataatagttccaatatacaaagttgaagaatatattgaacgttgtgcacaatctctgtttgagcagacttttcaagatattgaatatatttttgttaatgacgctacccccgataatagtgttggaaagttacttagcgtgatcagtagatatgaaaatagaatcgatcgtgttaaaatcataaatcatgatgtgaataaaggactatcgtctgctagaaagactggattattcacagcttctggagactattgtatccatattgatagcgacgatcgagtagaaactgagatgattgcatgtttatataatacggctataaaagagggggcagatattgtagggtgtgattattatgatgagtatgttggaatggtgagctataatagacagtttctggcaactgaaaatttagtttgtataaaacagatgttttctcgaaaaatttcacattgtgtgtggaataaattgattaaaagaagtttgtattttgataataacgtatttccaatagaaaatattggtaatggagaagatttagctttaactcctagattatttttttatgcaaaaaaaatagcttatgtgccgagagctttgtactattattcgcatttgaatacttattcctattcgaatcaagtaagctataagtcttatgaagatttattgtttgtaattaaatatattgaaacatttttcgcggaccaaaagtattcctttcggttatataaaagttttttagaattgaaatttttcgtaaaattgcaattactgattgatcataattttgtatcttgggcctctttataccctgaagttgattgttatatttggcaatacaaagatattcctttaaagtatcgtattattggttttttagcctcacaccatatgtgtattttaggtaaattgttttttaatattggtattcatataaaaaaatgcattgatgtcttttttcttactaaataagaagatactatttactattctttttattgaatctatctttatattcttttttgctcctaatcattatgaatataggttcaatttgttttgtgtaatacaatttgtagtaagttgtattgtgtttttcttatgtaaacgaaaaaataactattttgattttgatagtatttttattctaagctatttttttgtgatgtttttttatccagtatttttatatcctattgatcctgttcgtttttttgcttttcagtatgattttaatgagagtgtaatttccaaatcaacagcgttgtctttattggggattcatgcatattttttggggagtgttgtttatagaccaaaacagcaaaaagttctgaaagaaaaaagaatatcgccacaattgttttctattttggctattatatcttttattatttatataagtttggggggatatgcggaattaaaaggattgtataaaggagagatctctaatagtagctctattgccaattatttttatttatttacttgtatatgcatttttgctatgctagttgtcttgtttaataattcttttattgttaataaacaaacagacatattaaagatgaaaataaaatccaaataagtacaagcaaataggctttatatcagacatttataaagaaatcgtttctttcagtttttttcgctattttctgttaattagttctttttgggtacatttttgttccttgtttgtttcttgatttcggttttaattcgtacatttgcatacgaaaaagaacgaatgaaagaatacgattatgccacgaataaagaagcctaaaaaagtaaaagagcccatccgtcttcggatgaaggatttgtccgatggcagcaaaagtctgtatctggatatataccgcaatggcaagcggacatatgagtacctgaagctgtatcttatcccgggaacggacaacaatacccgtcggcagaatgaaataacaatggccgctgcgaatgccatcaagtcgaaacgcattatcgaactgaccagcggcgaagccggtatcgtgaaccatacagataaggtttatctgctggactggatgcaaacctatttggagtaccaagagaaacgcgacaagaaaggcatcggtcaaatcaaggccgttacccatatcctgaaagaatatgcaggggaaaggtttttgttggatcgggttgacctcgctttttgccaaggctatatcgactacatgctgacgaccttccgccctaaaggaaagccgatagcagcatctacacgcaatacctattatcagatattcaacggtgccctgaacactgccgtccgggctaaacggttgttgagaaatccgtttaatgaaatggaaaaatcggagaagcccaaaatgccggagagcgtgcggtcctatatgaccatcgaagaggtacgggcgttgattgccactccggtacaggatgggagggttaaaaacgcctatctgttttcctgcttctgcggactgcgtatcagcgatattgtcggcctgaaatggaagaatgtctttgtcgataacggccaataccgtctggcggtggctatgcagaagaccaaagaaccgatttacctgccactctccaacgaggcgttgaagtggatgccggagcgtgaggacaaggcggcggatgaccatgtgttcagcttgccttcaaacatcaaccagtatctcaagccgtgggccgaagcggccggaatcaccaagcgttttacttttcacacggcccggcacacattcgcgaccatgatgctgacgctcggtgcggatctctataccgtatcgaagctgcttggtcatacctccgtgagaatgacacaggtgtacgccaaaatcatcaaccagaaaaaagacgaagcagtcaatttggtcaacgggctattcgactgatgtagttatacatgtcaaattcaatttacaggtaaatatttccggcttttctccgacttttcaaatagtcgaagtaatgccactattataataagtataaacccataaaaacaattcgacatgaaaggacaaaacaacaggtcctctctttttttgaagggagaccacatctgcaccacttcgctacggaacaggatgtagcggaagaattttacgaattgctctccgaagcgagggagctttatcttcaagacgtcatggcaggcggcaaacggtatggccgctatgtggatgactttataaacagtcaccggtacatcgactgcaacagtgcggtttgcaggaattgccatgaaatgaacatccatatcatcagagggctgttgatcgattgcacaagtctcgtcaaaagcctctttaccgcagaaacattttctttcgaggagtgcatggccttgaaacgaaagtacgacattgccggagtatggttcggctcttcacgtatagaagattccagaaacgatccacctctctccttcggttgtaatttttcccgtgaacagatgacaggtattgtggcttgcgccaacgcttatcatctgttttgcgtttccacactccgcatcgaggacatggaagcgctttttgcctgcaagaagggcttctgcatacgtgtgaacaatatccgccatgtggcggtcctgttcgacgcgttgctcgaaaacaccttcatcctgcctcactggcagtcggttctcgacaaggggcggttcctgttgtccaaagacggcacaagatacgttaccgcttcaagcctctcgtccgccctgtctgcggcgaggaacaacattacatcggcaaacctcggcatacgaaaagccgtcagccgactgaaaatatgacacgaagtgccaaaaagccaagtatgtgaaagataaaacagtgacagttgccgtgatacgtgcatagtatcacgccggtatttccggctgtccggttcacatcacataactttgacctccgttagcgcgctgcataacggaggtaactctccattgtctaattttaacatgtattttatgcaaaacagaacaacattcatggagcggttgagcgaacggctgaccgccatagaagcggttctcaagaagttggaaccggtggaaggtctgttggagcgtgtggctttgctggaaaataccatttacacgaccaagaaggtcttcacttttcaagaggcgtgcatgtatatcggcgtgtccgaaagtatgttgtacaaactcacatcgaacaaggaaatcccgcactacaagcctcgcggcaagatgctctactttgcgaaggaagagctggacgcgtggctcttgcaaaactacgaacctacggtggacgatgccatgcgtatggcgacggaagtgtccgcaacccaaccgttctttaaccagaagcgctatggaaaacgaaaaaagaactgaccgtaactcgtgggcggagctggacgagaaccgcctgtcggatatcctcactgcatcgcaaataaaggccacggacacctacgagactccgccccagattatatggattgacaactccaccatagcgacgctcggtaatttcagcgcttcgacgggtaaggcgaaggcgaaaaagacgttcaacgtctcggccatcgtcgccgcgtcgctggcgggccggcaggtcttgaactatcgggcgcacctgcccgaaggcaaacgcaggattctgtacgtggacactgaacagagccgtttccattgccacaacgtattggaacgcattctccgcctggcggggctgcccaccacgacggacaacgagaatctcgatttcatttgcctgcgggaatacactcctgccgtccgtatcggggttatcgactatgccctgcgtcagaacaaggggtatgggctggtcatcatagacggcatccgcgacctgatgctcgacatcaacagcaccagcgaatcggtggaggtcatcaacaagatgatggagtggtcgtcgaaatacgacctgcacatccattgtgtgctacacctgaacaagggcgacaacaatgtgcgcgggcatatcggtacggaaatgagcaataaggcggaaacggtgctggtcatcaccaaaagtgcggagaatcccgttatcagtgaagttcatgcgctgcatatccgcgagaaggagttcaaaccgttcgccttttccgttgatgacgaagggttgccggtcatggtggataactattcgtttgacggcagtgtaagaccgaaagcccggagcagcttcatggatttgtccatcgaacagcaccgggaggcactttccgccgctttcggggacaggcccatcaaaggtttcgagaacgtgctgcaggccctcatggcttcctatgaggctatcgggttcaaacggggacgcagcgtcatgataaaactgctgcaatacctgacggaaaacctgaagctgatcgtcaaacgggacaagctcttttattacgatgtgaccccgaccgaagccctgcttttcgacgaagaatgcgaggaagcggaaggtgaaaaataatttagtttactttggtccgggtatatataggagaaaaaccaaagtaaactgttttttgaaaacaagtgaaaagaaaatgacatgaccatagcggaagcaaaacaactgcgtatcgtggactatctcgccagtctcggctaccatccccagagtgtgatatcaaaacaatactggtatctgtcaccgctgcgcgatgaacgcactccgtcgttcaaggtcaacgaccggctcaacgaatggtatgactttggcgcagcgacgggcggcgaccttgtggaactgggcaaatacctgtaccggacgaacagcgtgagcgaagtgcttgcctgtatcgggagacatgaaaatgctgccccgatacaaagagtgcggattccggggacaacaccccgtcccgtcgaagctgacatgaaggacgtgctcgtcgtgccgttgcagcaccatgcgctactctcgtaccttcattcccgtggaatcgacggggacatcggccgcatgttctgccgggaggtccattatgaattacgtaaacggcgctacttcgctcttgccttcggcaacgcggcgggcgggtacgaggtgcgcaatccttattataagggctgtatccggtgtaaggacatctctgtcatcaggcaatctcatggtgaaacacagaaccgtgtttgcgtgttcgagggcttcatggattttctctcttacctgacgctgaaacaggcgggtgatgatacggtctgcatcgacgcaccttgtgattacctcgtgatgaactcggtgaacaacctgaaaaaagcattggaacacttgcaggtgtacgaggaaatccactgttatctcgacaatgatctcgcagggcagaaaacggaagagaccatcgccggcatgtatggcgggcgtgtacgcaacgaagcaccccgttatcgcgaatacaaggacctgaacgattacctacgcggaaagaaacggtaaggcatcatcgttaccctttcccttgaaagctctcctcccggagggctttttttatgcccgatttttctgcttcgatacctcaaagtatgaaattaaagttcaattttagtgtttcaaacttatttctatgtaataaaatactgtttgatataaagagtttttgttacatcaaatataatatttttctttgcaaccgtacttttaaagttcaattaaagtttaatttcatacttaaaaacagatgggttcatactttatattcgcccttgtactgacggtgctgtacatcgtctatttcgcggtcaatatcatccgtgacctgtatggaaagaagggaacggagaagactgacgaggaagttttcgacctcggtccgatggattccacggaagagagtgtcgaggtttcggagaacgagaccgggttcaaaatcggaaatgaaacatacggcacggagactgtacctgccgcttcgcctgccgcccaaaacggcgacaccgggaaaaaagatggaacagccaaggatcggctcgaacggctgaaagccaaggcagaggcacagatggaaaaggtcgcaccctacctgtccgacggctttaccgacgaagagatgtataaggcaatgatttccaaaggacgcttggacaaccgtcccagcctgaaatggagaccggtcaaagataagctgtaagatgtcgaaaacgaagaagatactatgtgcgctttgttccatcatcccctgttcggctctggcgaaaagcggcagcgtgaattacagttggggggcggatgcgctggcgacgatgcacgactacgtggtaacgatgatgttctacgtccaagctctctgttgtgccatcgccgggatttgtgtgattgtgtccggattccagatttacgtaaagatgaacacgggcgaggacggtattaccaagtccgtcgtaacgcttgtgggcgcgtgcctgttcctgatcggtgccttccttgtctttcctgcctttttcggctatcgcatatagaaacgggatgcaggaatgaggtgccgccataacgattcgaaagaactgcaatacttaccctaaaataaataatcatgtttcaaaaaacaaaaagacaaatgaaaagaatgttttctgctaaaaaggtacagatgctcacactgatgttgctgtgtggcacgacggccgtcatggcccaaaactccgcaggcgattactccgccggtacgaccgcactggcgaccgtgacggaggaaatcgccaagtacgtccccgtcatggtcaaactgtgttacgccattgccggtgtagtggctatcgtaggcgctatctcggtgtacatcgccatgaacaacgaggaacaggacgtgaagaaaaagattatgatgatcgttggcgcatgtattttcttaatcgctgccgcacaagcacttccgatgttcttcggtatcggcgcataaccctcccgcacgatgaaaggcaaggacgaacgctatcccgactacccgctgttcaagggcctgcaacggcctttggagttcatgggtattcagggacgctacatctactgggcggcgggcgttgccggcggagccatcgtcggatttatcatcgcctactgcctcgtgggtttcgtggccggactggtcgtgctggttgcggtcgtctcgacgggtattgcgcttatcatgctcaaacagcggaaagggctgcataccaagaaagacggtcgcggagtgtatatctacgcccactcgaagaaactgtgagaagaaaagaaaaaccatcacgggcaacgtgtggtcttgttgaatgttgaacgcgggccggccgcctgaaatccgggtggaccggccttttttattgtattttgaaatgaccttgtacatcattctactttttatcgccttgtgtgccggcatggccctgtcggtctatgcgttcggtaccggaggcaagcgtaagcgtatctttcaggacatctatttttctgtggaagatacgaacggcgtgggcgtgctgtacaccaagacgggcgaatattcagccatcctgaaaatagagaatcccgtgcagaaatactgtgcgaacatcgacagctactacgagttcacgcaccttttcaccgccctcgcgcagacgctcggcgaaggatatgccctgcacaaacaggacatcttcatccggaaacagttcgagaacgagacgggggacaaacacgagttcctctcatcggcctacttccgttacttcaaggggcgtaactatacggacagcgtgtgttacctgaccatcacgcaggaggcgaagaagagccgcctgttctcgttcgacaacaagaagtggcgcgactttctggtcaagatacgcaaagtgcatgaccagctgcacgatgccggggtacaggccaggttcctgaacaaagccgaagcgagcgaatacgtggaccgctatttcgccatgaacttcaaggagcggatcgtgtcgatgaccaacttcaaggcggacgacgaaacggtctcgatgggcgacaaacgctgcaaggtatatagccttgtcgatgtggactgtgccgcactgccctcactgatacggccttacaccaatatagaggtcaataacacggatatgcccgtggacctgctggctgccatcgacaacattccgaatgcggagacggtcgtctataaccagattgtcttcctgcccaaccagaaaagggaactggccctgctggacaaaaagaagaaccggcacgccagtattcccaatccgagcaaccagatggccgtggaggacatcaagcgggtgcaggaggtcatcgcgcgggaaagcaagcagctcgtgtacacccatttcaacctgatcgtcgccgtaccggccgatacggacctgcaaaaatgcacgaaccacttggagaatgctttcggacgtatgggtatccatatttccaaaagggcgtacaaccaactggaactgttcgtgaactcgtttccgggtaactgttacggcatgaacgaggactatgaccgcttcctgacgctgggtgacgcggcgatgtgtctgatgtataaggagcacatacagcacagcgaggagacaccgctgaaaatctactacacagaccgccaaggcgtgccggtggctatcgacatcacgggaaaggaggggaaaaacaagctgacggacaactcgaactttttctgtctcggtccttcgggcagcggcaagagcttccacatgaactctgtcgtgcgccagttgtacgagcaaggaacggacgtggtgatggtcgatacgggtaacagctacgagggactttgcgaatacctcggcggcaagtacatttcctataccgaggaaagaccgattacgatgaacccattccgcatcaatcgggcggaaatgaatgtggagaagacgggcttcctgaaaaacctcgtgctgctcatctggaaaggctcgcagggtacggtcacaaagacagaggaccgcctgatagaacaggtcatcacggagtattacgacacttatttcaatgggttcgacggcttcacacccctgcaacgggaggatttgcgtaaggggctgctcatcgacgaccgtaaccatgccgagaagcaggacgaggacgaaggagagcggaccgggcgtatcgagcgcatgatcgacgagatggaacgccgccgtaaggagttgaaagtggaagagctgtcgttcaactcgttctatgaattttccgtgcagcgcatccccgacatctgtgccgaaaaccatatttcgggcatcgacatatcgacgtaccgttacatgatgaaggacttctatcggggcggcaatcatgaaaagacgctgaacgagaacatggacagttcattgttcgatgagacgttcatcgtcttcgaaattgacagtataaaggatgatcctctcctgttccctcttgtcacactgattatcatggatgtattcttacagaagatgcgtatcaagaagaaccgcaaagtcctggtcatagaggaagcgtggaaggccattgccagcccgctcatggccgaatacatcaagtttatgtacaagacggcccgtaagttctgggcctcggtcggcgtggtgacgcaggagatacaggacatcatcggcagccctatcgtcaaggaagccatcatcaacaactccgacgtggtgatgctgcttgaccagagcaagttccgcgagcggttcgatgaaatcaaggctattctcggacttaccgacgtggactgcaaaaagatattcaccatcaaccggctggaaaacaaggaagggcgcagcttcttccgagaggtgttcatccgccgggggacgaccagcggcgtgtacggcgtggaagaaccaagagagtgttacatgacctacaccaccgagcgggcggagaaagaagccctgaaactctacaagcgggaattgcggtgcagccatcaggaagctatcgaggcgtactgtcgggattggaacgccagcggtatcggaaaatccctgccgttcgcccaaaaggtcaacgaggccgggcggatattgaaccttcatgtaaaacaataacaatcaaatcatcaattacagaaaatggaaaagatagacatcagccaaagcgtgaagacacttgagttcgggagcaaatatgaagcccgtatccaacggatattccgtgagttcgacatcaaaaccatccgggatttgtgccaatggcccggaaaggacttggtaagggtacgcgacatgggaagaaaaagcatcgaggaaatagaggatgttctggaaaggtacaatctccggttgggaatgcccggtaaggaactggacgaatacgccggtatcggaaattccgtgcaggacgaggaagaagaggcgaagtgggaacaacgcaggtacgagatagccaaggaggtattcatacaccaccgtctggtggcaaattccgccgtatatgaggccgacgaactgatacgtgcactaagaggcatgacgcgccgttgacgggggctgtttttaaccggggaggaatccatgatgaaacggctgtcacttatccttatgctcctgtcgctcgttgtcgtacagcacatccacgcgcagtattacagcgtgaactacgatgcgcgtaccgtggcggcaatggctaccgctttcggtacggaagccgtggcggaaagctattaccgggagcaggtcgatgacatactcaagcactacaatgcggcggaagtggccacggcggggatttttgcctccaagttcttggagcataaagccttttccgacctcggtatctggaacagcagtacggagaactactactaccgccgcatttaccgcatggtctcggagaagatcatacccaagatatgggtggtggcgaaactgatgctccgctcaccgcaaacggctatctactggggcagctacctgatgaaaatctgcgacgaaacgaaaagcctgtgtatgcagttcgagagtgtagtgacgaacagcacgttgggcttttcggacatcgtgtttctggaaatcaaccggaacatcgcccctctgttgaaactctcggagataggcgacatcgactggcagcacatgctggacgacatcgccagcgtgccgggcaatttcaccaaggagaacctgcaacacgacatcgacaacctctacaacatgggtgtcggtctcgcctcggcaggtatcgggaacattggtgacgccctgttgcaaaccagttcgttccatgagctgatgggcggcagggtcagcaaggtcatcgacctgtatgaccattacggtgcgctcttcgagcaggcggagcatgacctcggcggcctgctgattgacatggtgggcggtgaggacaacgtggcgggactgttcgatttcagcaactacgaccttacctcctggatgacggactatctggacgagacggcgggaaactactacacgcaacggtggtatatcgcccggcgtgagcaagggagtatcgccttgtgcgactactacccgccgacggacgataacagcatactgaacggcggcgaatggacgcgtttcgagacaaccgatcccgacttttatcccaatgcctcgcaacgggagcaggcgctcgccaattcggaacggtacgccggttggtcgagaagccgggtacagcagctcaacaaccagaatgacggctatacctatagtatcaactactggcagaacggctatatcatcagccggggcggcaaacagacgaagaaggcatacgcctacgaaatccatgtgaagaaaagctggaaccgggaagaggtcgtctatgaagaggtgttcgattcctactcgatggacctgaacacgttcaaagccgggcttaacgcccgactctcggagttcaacgacaacgaggaaggttatacctattatatagcttctgacgcgcggaactattatcaggcgacggacgccgcgaaattgcaaggctgcgagagcgtgaccatcagtgtaacctgttcggacggggctacgctcggtcagggcacgacgcagtacaagtgccgaacgtgcggcaaatccctgaacgcccattcaaaggagtgtgccatgcagaccacggttacggagaacgaactggacttgtccgagctggacgccatgctgcaggaggcagagaatcaggtagccgccatccagtcgcaaatcaacgcgttggagagcgagaatgccgacctgctgaaaaaaatcgccgaggcaagcgtggaagatgcggcggtgtaccggcagcagtacaacgcgaacaagacacagatagaccgcctgaaaagcgagctgtccgaatggcagaagaaacaacgggaatacaccgacgcgaaaaccgaggcgtcgggcgataacgatgtggcaacagacgactattaccgcataccggccatcatgcaggactgcaagacggcttacagcctgtcgtggcaggacggcggggcgtggaacggctacacctatgtccgtaaggcgaccatgccgaacatcaacggggtcatcacgttcaaggcgacggtctcgatagcccgcaaaccgaaatatttcctcggtatcaagatacaccgtgccatcgtgcagatcagttgggaactgaccacggaatacaccgacacgtatgtggccgacgtgctgacgctcgaccctaacctgtcggacgcggagaaaacgaaactggtgaacgaccgtattgcggagattgcacgagagcatccttcgtgcaagatcacgacggaatatgcccgtaccccaccattggaagagactccgaccggggaggtgtaccatctgctgtggtcaagcgaccggctcgaaatcgcacgggaagtggattcccggattacgatgatatatgccgacctcgtgtcactggagaagatgatgcactacaaacggagcatcatcgacgtgctgaaggacgtgctgcccgaattggatatggacgagggacgcaggctgacgctcgtggaggaatgccacgaacgctgggtggagaatgcgcggaacctgcggagcggaaacggcaggaacggcaaaggcagcggaaaggaggtgcggccatgaaacgtgccctgctgatggcagtcgtgctgctggctctcctgcccggcattgccaaggcgcaatggacgttcgacatcgtgtcggtagaagcctacatcaacgaccacaagaagcaacgcagcctgctgctggcccgcagtacgctggaatacagcaacaagctgctgcacgagtacagccgcaaagaggtcggcgagtacaaggaactgaatgtggacttggaccgctacacccgtgccttcgacgtcatcgacgtgatgtaccagtccttgcggacggtgctgaacgtgaaaagcacctatacggcggtcagcgaccgtatcggcgattacaagagactgctggaggacttcaacgatagaatcgtgaaacgggggcgcatcgaccccggcgatgccgtgatactggccatcaacgaaaaggcaatacgggacatcgccgatgacgggaaacagctttacaaatcggtcagtgacctcgtgctgtatgccacaggggcggcagaatgttcgacctccgacctgctgatggtgctggaagcggtgaacacgtcgctggacgacatcgagcggcacctgaaccgggcgtatatcgagacgtggcggtacatacaggtgcgcatcggttactggaaagcgaagatttaccgtcccaaggtcaaggagattatcgacggggctttcggacgatggcgcaaagcgggacggctggattattaacgaacgataaaagggaaagaaggcaaactatctacaggttagagtttgacttccatgccatcgacatcgggaaataaaaacagagaaagaatttttagtacaaacaagcctattgggattataccaagggataaaaagacattcagattgatgcaatggaaaagattgtttttgcaaaagacattacgttatataaggccgattgtcttgaagtgatgccttttcttccggaatcaagcattgatttggttttatgcgatcccccttttggaattacagcttcacagtgggataaaataataccattcccggaaatgtggaaagagatcaggagagtcaggaaagaaaatgcacctacggtcttatttggcagcgaaccgttcagcagctttctacgctgcggcaatttagatgaatttaaatatgactgggtttgggaaaagtcaaaagcaagcaattttcttctcgctaaaaaacaacctctaaaagcacatgagctaataagtgtctttggcaaaggcagaaccccttattatccaatcatggaggaaggcgagccttacgggaaccgcacgaagagaggaagcaattggacagggataaacaatgtacccaatcctacattcaggcatgaaaacaaagggacaagatatccacgaagtgtgatatacttcaaaacagcggaatcggaaggcaaaacgattcatgtcaaccaaaagccgattgcattattggagtatctgataaaaacatacacaaaggaaggagatactgtccttgattttgcttcggggagcatgagcaccgcaattgcctgtatctatacgaatagaaaatgtatttgcattgaaaaagacgagacatatttctcgcaaggagagaaacgagtcaggaatgaataccaatatttatgacagtaaaggaagctcaaaaaaagtatgactatacgatataaataactgtaaaataatgaataaccggaaattaatatgaacagaactctcttactcatggcggttgcagcagttgcaacgagcggtgtcaaggcgcagtcggttacttacaaccatgactcgccgaaacagaaccagattacggttatggaaaccggtacgggcgctctgtcgcccgaactttattacacgctgctgcacaacaagtacaagaagtcggcggcaagcaagaacaaactgtcgttccgcacgctggcgggtgtgaacctgtacaaccagacagacgaggcggaagccatcgactcggcactggtcaagcgggccgaaatcgaggcactgaatgtagccgaccggcagattgacctcgcgtggctggccgagggcgataagataaacgctcaaatggaacggcttcagcgcaacatcgaccgcatcccccttgccgggggcacaacggacgacagggagcggtggacggaatactaccacgtctaccagtgcgccattgacgctacgaaggacgcctacatgcccaacgcacaacggaagaaagagtacctgcgaatctacgaggacgtggtacggcagaacgagattctggtcggctaccttgcccgaagacagaacgccacggttgcgaacgggctgctgaatgcaaccgccgaccggagactggacaagggcggtatcgtccgcgaggcgatgggccggtggaacgaatcgcgttccgccgtgcgaggggcgcaatcgggcggcgaaactgatacgggagacggagacgagacggtaaacagaaagaactaaaaacacacaacgtatggcagacggaaatattctttcggatttcggtatcgacctcttggaagaggaaatcgacgacgtgatttttcagaccaacgagtttctgaccgatgcgacctttaccggctcgcaaggtcccttctggtggattcttcaaatgtgcatggcactggccgccctattcgccatcatcatggcggcaggcatggcgtacaaaatgatggtcaagcacgagcctttggacgtgatgaagctcttcagaccgctggccgtgtcgcttatcctctgctggtggtatcctccggcagacacgggcatggcaaacagcgggagcaactggtgctttttagatttcctctcctatatcccgaactgcgtcggttcgtacacacatgacctgtacgaggccgaagcctcgcaaatctcggacaagttcgaggaagtgcaggagttgatttacgtgcgcgacacgatgtacactgccctgcaggcacaggccgatgtcgcccatacgggtacgtcggacccaaaccttatcgaggcaacgatggaacagacaggtgtggacgaggtaacgaacatggagaaggatgcggcgaagctgtggttcacctcgctgacttcgggggtaatcgtggggattgacaaaatcatcatgctgatagcccttgtagtattcagaatcggttggtgggcgaccatctattgtcagcaaattcttttgggaatgctcaccattttcggacctatccaatgggcgttctcgctcctgcccaagtgggaaggcgcatgggcgaagtggctcacaaggtatctgacggtgcatttctatggtgcgatgctctacttcgtgggcttctacgtgctgctgctgttcgacatcgtactttgcatacaggtagagaacctaacggcgataacggcaagcgagcagacgatggcggcttacctgcaaaactccttcttctcggcgggctatctgatggcggcaagcatcgtggccctaaaatgcctgaacctcgtccccgaccttgcggcatggatgataccggagggtgacacggcgttctcaacccgaaacttcggcgagggcgtggcacagcaggccaaaatgacggcgacgggcgcaatgggtacggtaatgagataacaaagtaacgataaatattcaaacaaaatggtcatcaagaatttagagaacaaaatcaaactggtcggaattatctgcaccgcctttctcgtggggtgcgtcatcatcagcgtgtcgagtatctggacggcccgcatgatggttacggacgctcaaaagaaggtgtatgtgctggacagcaacgtgcctatactggtacgccgcacgacgatggaggaaacgcttgacgtggaagccaagagccatgtcgagatgttccaccactacttctttacccttgctcccgacgacaagtacatccgctacacgatggagaaagcgatgtacttagtggacgaaacgggcttggcacagtacaatacgctcaaggagaaaggtttctattccaacatcttgggaacgagtgccgtcttttcgattttctgcgacagtatcaccttcaacaaggagaagatggagttcacttactacgggcggcagcgtatcgaacggcgcagcaatatcctgatgcgcgaactggttacggcgggacagctcaagcgtgtaccccggacggagaacaacccgcacgggctgctcattgtgaactggcgcacgctgctgaacaaggacatcgagcaaaagacaaaaagcaactattaactctaccagtcctatgaatatcaaaggattcagacgtatgctgttcggcgagaagatgccggacaagaacgacccgaaatacaaggagcgctacgaacgcgacgtggatgccgggcgacgcttcgccaaagcgacacgtatcgacaaggcagtggccaaagtacagggtttcgccaacgcccaccggacgctgtttctcgtcatcgtatttggcttcgccatctgcgggctgacatggaatatttaccgcctgacggtggtgtaccgccatcatccgacccgccggacggccacggagatgcaggattccgtgctccgggaacggcataagatgctttccgtaccgcatgtacgaagattcgatacgaaggaaagtggtacggaaaggccggaatagaacggcaggcttatgaatatgccgtttgagagaactataagcaagtatgtgcaactcaattaaagggaaacaatgaacaatatcttcaagagaattaatttcaggcagccaaagtatatgcttccggctatcctctatattccccttctcggcacgtcgtacttctttttcgacctgttccataccgagaaggtcgaggtacaggataagacactccagacgaccgagttcctgaatcccgaattgccggacgcccaaatcaagggtggcgacggtatcggcagcaagtatgagaacatggccaaatcatggggcaagatacaagattattccgctgtggacaacatcgagcgggacgaaccggacaataaccaagaggaatatgaatcgcagtacaccgaagaggacatcgccctgcttgaccggcaggaaaaggaaaatgatctggcagcggaagcggccgatgccaagaggcgggagcaggaagctctcgcagaactggaaaaagcactcgccgaagcgaggttgagaggacaacgggaggtcatgccgtccgaaacggacagcaccgcaacggcggctccgccggacacgatgacgcaggccaagggaaccatcgacgaggaaagccgttcggtcaaagctcctgcggagacggacaaggcaagcgaggtggtgaagaaggtaaagacggcttcggactacttcaacacactggcgaaagacgctcgggaaccgaaactcatcaaggcgatcatcgacgagaacatcaaggccgtggacggctcgcgtgtgcggctgcgcctgctggacgacatcgaaatcaacgagagcgtggtcaggcgtggtacttacctgtatgccacagtcagcggtttctcttccggacgtgtaaaaggaagcatcaacagcatattggtggaggacgaactggtcaaggtcagcttgtcaatctacgatacggacgggctggaaggactttacgtacccatcagccagttccgcgagacaagcaaggatgtggcgagcagtgccatgtcgggcagcatgaacatgaataccagcggatacggtaacagcctcgcccaatggggtatgcaggcggtgaacaatgcctaccagaaaacgagtaacgccatcagcaaggctatcaagaaaaacaaggtgaagctgaaatacgggacgtttgtgtatctggtgaacggacgggaaaacaggaactaaaagggcagtgacaatggaatcagacatatcaaaacttcataagggaacggacggcttctattacgaggactacatcgctcccgataagcccgaaacattcgttgggaagctcgtaagtaccgaatggtggcacaaaggggtacgattcgccctgatatgcaactttcaggcagaagacgggcggaggattgccttattcgccttccagaagcataccggtttttacgggccgagagacggtgcggtcaatttcaaacatgtggagaagaataccctctgggagtgtgaaatccggaaaacccggacggaacgctgtacctggatgagcgcccgacaaattgtagaactgaaaacagacgcaatatgatagagacggatcgcatttaccttatggactgcatggagggcatgaaacagatagcggatagtagcgtggacgccataatcgccgacctgccttacggggtgttaaatcgcagcaatccgtcggtgaactgggaccgccagataccgttcgcagccttgtgggagcaataccggcggattaccaagccggacagccccattatcctgttcggacaggggcttttctccgcatggctcatgctgtcgcaaccccggctatggcggtacaacctcgtgtggcagaaagatcgggtgacgggacatctcaatgccaaacgtatgccgctccggcagcacgaggatattctggtattctataaaaaacagccggtctatcatccgcagatgacaccgtgtcctccggaacggagaaatcacgggaggcgtaaaacggagggatttaccaaccgttgttacggaacgatgaaactctcaccggtacgcatagccgatgacaaatatccgacctcggtcatcttcatgccgaaggaacacaagaaaggcgcgttctaccacccgacacaaaagcccgtggcgttgatggagtacctgatacggacctacaccgacgaaggcgatgttgtactggacaactgtatcgggtcaggcacaaccgccgtggccgctatccgcacgggacgacactacatcggatttgaaatcgaacaggtgtactgcgagattgccgaacggcggattcaggaggaactggaatgcaggaacaaagcacaagaggaaaaagagataagggaagaaaaacaaaatcaataaatcaatgacatggacaaaaaaggaatcgtaacggcatttcttctggcggcaggactgctgggaacgccgaatgtacaggcacaacgaacctacgaggagatggaacaacttacggtaaatgaacaggtaacgacggtcatcacggcctcggaaccggtacgcttcgtggacatctccaccgataaggttgtcggtgaccagccgatagataacatcgtccgcctgaaaccgaaagagggcggacacgaggacggcgaggtgctggccatagtgaccatcgtaacggaacgctaccgcacgcagtatgcactgctctacaccacacgggtgcgggaggcggtaactgacaaggaaatccagttgcaggaacgaaacgcctaccacaacccggcggtctcgatgtccaccgtggagatgacacgcttcgcccggcgtatctggaactcgcccgcgaagatccgcaacgtcgccaccaaggcacaccgcatgaccatgcggttgaacaacatctacaccgtgggagagtatttcttcatcgacttctcaatagagaaccggacgaacatacgtttcgacattgacgagatacgggtgaagctggcggacaagaaactgaccaaagcgactaatgtgcaagtcatcgaactggtcccggaactggtgctggagacgggcaagacgttccggcacggctaccggaatgtggtcgtggtcaggaaaatgacgttcccgaacgacaaggtactgaccatcgagatgacggagaaacaaatcagcgggcgtgctatcagcctgaatatcgactatgaggacgtgctgtcggccgattcgttcagcacggcattgctggaggaggaatgacaatgagaaagacgattatcctgacgattgcctgcatgtgcctcgccgtcggcgcgaatgcacaacggggcagcggccgcctttcgctcggagcggggctgctgtacaagaacgagctggacgtgacgctggcctacgaacacgagatgaactaccgccatgcgtgggagttctttgccaacggctacctgcaatgggcagagtgcgaatcctgcaagcatgtatgcccgaaatctttctggcagaattaccgtacctacggcttcggcgtggcttacaaaccctgcgtcacgaggggacgcaaccattacggaagcctccgtatcggggcttcgggcggaagcgatacgaggaagttccttgtcgggctgcatttcggctacgagcacaactatgtgttgcgggcgggctggacgctatactggcaagtcaagggagacgtgatgataaagggggccgatgtgctgcgtacaggagttgccctcggtattaaactacctataaaataagggaaagatgaaacagaacactatcagaaaaacgtgccaggtagtgccggttctcctcataaccggggcattggctgcctgcgacgcacatatagaagaacccgacaagacggtacgtcccggacatgtcctctgcgtggacggcaaggccgtgccgtacagcgagtatgaaaattccgggaaacaggcgattgccgtcgtcttccatacctattcggacggggaaacggaaggaaacggctatgccgtctatctgtgggacatgacgccgaaggcttttgccgacagcctcggtgtcgagcagggtacgtcggcggacattgctgcatacgacgggaatgagaacacgttcgccctgtacgatacggaagaaacggcctcgccgatggctgaagccgtttttgccttgtggaaatacggacagagcgcctatatcccctcggtggcacagatgcgtctgctgtattcggcacagaccgtcatcaatccgattatcgagaaatgcggcggcgacccgctgccgaccgaggccgacgagtgctggtattggacatcgacggaggtggaaggacagcagacagtcaaagcatggctctactcgacagccagcggaaccatgcaggaaacgcccaagacacaggcgcataaagtgcgtcccattataaccatcaacaactgaatttatgattatgaacggaattaaagattttcaagcaccacagtatgtggatatagtacatccggacaaaggattcttcgggtatctgttaagatgcaaatgtcctaaacaagaggacgtttccggtaatttcatattcctcgacgatggaatagactgctacaagaggtttccctccgtaaagaatcgcagggaagaaatccgggcagaatggaacggccgtatcagccgttaccatgatattttccaaggtcagctctgctatgtcaatgaagaattgattgaagatttcattgatttcatgacttatggctctgacaatgccgtccggattttccttgagaagtttacagcggaagtacgggcttctgcaatatatgacgggcttaaacctctatatgcagtttcccatgtctgccagctttccgctgataaccgtatgcaatggcctcacatccacgtcctctggggtattaaaaagaattgacatagcaatggaagagagcaaggaattacagggattttaccggatattccgtgcggtggtgtatgtctccgtactgatggagtttttcgagtatgccatcgacccggccatgctggaccactggggcggcatactctgcgacattcacggacgtatcaaacggtgggccatctataacgacggcaacctcgtgtacagcaaggtcgccacggtgctgctgatctgcattacctgtatcggcaccagagccaagaaacatttggaattcaacgcccggcggcaggtcttgtacccgctcgtgagcggctttgccctgttagtgctgtccgtatggctgttcggtcatccgatggagacgcggttctacacgctgccgctgaacattattctctatatggcggtatcgctcacgggggttatcctcgtgcatgtcgcactggataacatctccaagttcctcaaagagggactgatgaaggatcgtttcaatttcgagaatgaaagtttcgagcaatgcgaggaactgatagagactccgtacagcgtgaatatccccatgcgatattactacaagggcaagttccgtaaaggctggaccaatataaccaactgttttcgtggaacatgggtagtcggaacaccggggtcgggcaagacattcagtatcatcgagccgtttatccgacagcactcggccaaggggttcgcgatggtggtctatgactacaagttcccgacgctggccacgaaactgtactaccactacaagaaaaaccagaagctcggaaagttgccccaaggctgccaattcaatatgattaacttcgtggacgtggagtacagccgccgggtaaatccaattcaggcaaaatacatcaacaacctcgctgcggcgagcgaaacggcggaaacgctgctggaatccctgcaaaaaggcaagaaagagggaggcggcggcagcgaccagtttttccagacttcggctgtgaacttcctcgccgcctgcatctactttttcgtgaactatgaacgcgagccttacgatgccaaaggaaacaaattgtacgctgaaaaacggcaggacccggagacgaaattctggaaaccgacgggtgtggtacgcgccaaagagggcggggaaatcgttgaacctgcctactggttaggcaagtattcggatatgccgcatatcctgtcgttcctgaacgagagttaccagaccatcttcgaggtactggagaccgacaacgaggttgccccgctgctcggtccgttccagaccgctttgaaaaatcgcgcgatggaacagttggaaggtatgatcggtacattgcgcgtctatacctctcgtctggcgaccaaagagagttactggatattccaccgtgacggtgatgacttcgacctgaaagtgagcgacccgaagaatccgagctacctgctgatagcgaacgatccggaaatggaaagcattatcggagcgttgaacgcccttatcctgaaccgcctcgttacccgtgtgaatacgggacagggcaaaaatgtccccgtgagcattatcgtggacgagctgccgacgctgtacttccacaagatagaccgcctgatcggcacggcacgaagcaacaaggtgagcgtgacgctcggcttccaagaactgccgcagctcgaagcggattacgggaaagtgggtatgcagaaaatcatcacgacggtgggtaacgtggtgagcggttcggcccgtgccaaggaaacgctggaatggttgtcgagcgacatcttcggcaaggtggtgcaaatcaagaagggtgtcacgatagaccgggacaagacttccatcaatctgaacgaaaatatggacagcctcgtacccgcctcgaaaatctcggatatgccgacgggctggatctgcggccagacggcacgggacttcatccaaacaaaaaccggcataggcggctcgatgaacgtgcaggaagcggaggagttcaagacctcgaagttcttctgcaagacggatttcgacatgaaggaaatcaagaaggaggaagcggcgtatgtaccgctgccgaagttctacacgttcaagtcgagagaggaacgggaacgcattctttaccggaattttgtgaatgtgggaatggaggtgaaagaaatgataaaggacgtgcagaacaaacgaggggcgaaataagaaacctgtttccgatatgagggaaagtaaaaaaaatgcctgcaatgattccgcgattattgcaggcgttttggcgtttccggtatcttggaaaatcctgtggagttggttttggtattcaatactacacaaaaagtatattataccgaaacaaaatcaactttcaagacctttggaacggaaaataatgctacctttgcagttgaaaaagaaaacaaatcatatactgtggatatagaacaaaaaagcaaaataaaccaactgctgctttccgccactcccaaaggattgttattctccgaatggctgaaaaggaacggttattccgaccagttgataaaaagataccgggaatccggctggcttgagatgctgtcaaagggagtcatgtaccgaacgggagacagcctgtcggcatacgccgcattgtcctgctacaacaggcaattgggcaagacgttccgtgtcgcagctcattctgcattggaactgttcggcttcaaccactatgtgcctatggggaaaccgttgctgatggtggcacacggcaaacagcgtgttccggaatggatacgccacgatgttttcgacagggtgataaaaccgttttccaccgataccttttcagaaccgcagaccgcaacgattgtgaaatacgaagtggatctgctggtttctacacctgaacaggcattcttggaatgtctgttgcttgcaccgcaacaatattcctatatggacttgttctatatgatggaacaactgacaacgctgcgtcccgaaatgctacagcaactgctcgaaacgaccaagaaccttaaagtaaagcgtatgttcctttatatggcagaaaaagcgggacactattggttcgaggcacttgatacatccaaaataggactgggaacctccaaattgcaactgtcaaaaaacgggatttatatctccaaatacaaaataaccgtacctaaagaactgaacgaatatgaatgacatctataaaaaacaggtggcattgttgatacgcattatgccgtccgtgtaccgcatcaaagattttgctgtgcatggaggtacggctatcaacctgtttcataaaaacatgcctcgctattcagtcgatatagacctcacctatattcccgtaaaggaaagggccgagagtctggacgcaatcaacaaccatctgcgaactttgaaaagctacatagaaaaatccataccgggcataaaagtgatccacaagcatgatgtctggaaattacaatgtactttggacggtgcgaccgtcaaaatcgaagtgaacgggacaaagcggggtatcatcggagagacagaggacaggaaactgtgcgaacgggctgaaacggagttcaatatgacctgtaaagcacgtacagtttcttattcgcagctttacgggggcaaaattgcagcggcattaagccgccaacacccacgggacctgttcgattgcaagtatatggaaatggcgtcgtttcatgatgtcaagaacggcttcatgctttgcctgttggggagcgacaagcctgtcatcgaatctttgcagccgaacgccatcgaccagacggaagcactggaaaagcagtttgagggaatgtccgatactccattcacttattcggattatgaagaggcaaggcataacctcattcagcaggtaaacgacagcctgaccgaaacagaccgggaatttcttctgtcatttgaaaacggcgaacccgattgggaaaaatgctgtgccggagatttaagccgctatccgtccgtaaaatggaaattacagaacattgccaagctgaaaaagagcaatcctcaaaagcacaaggcgggattggaaaagctacagaccttcttatttccgaagaagggataagtttttatgggcatcatgccggacagattggtgttaacggaaaaacaatatttggaatcatgtacaatatgcgagaaataaaagaggaagactttgaagcggtggcaaaatttgaaattgaaatttctgaaatctcattcggagaaaaggctattactgacctcgagttccactgcaagaaattagccaaagcaaaagaccgacgcggaatgatcgtgatagaagacacggaatccggtaaaattgtgggctgggtatggatggagaaaaagcagaacagcctgaccggagaggtttatgccaacttcaagtccatttatgcggatgagtgcattcgaggaatgcaaattgtagacgacctgtttgaaaaaagcatagaatatgcgagagagtgcaaggcggcttatattgtcggcaaggttcatgccgggaacgtaccgatgcgctctttgtataaaaagcattgcttcgagccaacccatgtaacgatggaaaggaaattgttatgataacgtccggcatacaaagttttgctctctcgcatggcgaacaatacaaacacggaagaacaagcctgcgtgacttgtcaggtaaactgcctttcgtggcaaacgggtgtaccatgctgttatgcgttgaaggccgggctgtcgtaaccaccaatacacgaaaacggacattccgcaaaggtgatttgcttgtgttgttttcggacaccttatttgcaccgctgtgtgtttctccttcattcacggcagaatatatatccttgtcattggaactgacaggggagattttctacaaaatgacttcccccgcattttgggacggactgtatgaatatccggtctgccgactttcggaagcacaatactcattggcagacggagtgttcaagcagatgatatgggcgatggagaacggtgatgaagaaagccggaaaaacatcctgcaaaattgcatttacaatgtttttctggctttagatattgtgttcaagccgatgtttcccgacttgggcaagtgttatcaaaaggatcagtcaagggtgctgttcggcaagttcatgtcactgctggctaagaatttccatgtaaaaagagatgtacgatattatgcggacaggctttgcatcacgaccgattacctttataagataacctgcaaaatagaacagcggactccgaaggaaatcattgacctgtttgtcgtaacggaactcaaacgctatttggacaacacagaacagtccgtcaaagacctggcccgtctgttccatttcgaagacgcgtcgtacctttgccgctttttccgccgcacggcaggctgttccgtttccgaataccgcaacaggcttggccgctcataggctccccgcatcaaatcgctgtattccactttcgcacatccgagccgctcctgcaaatagtcgaaagcagtccacggacggacattggtgccgcatgtgaacaaatcgacagcggcataaccacactccggccacgtgtgtatggtcaagtgggattcttggatgaccaccacaccgctcacacccactggggcgtatttgtgaaagttttcctgtactatggtcgctccggcacttactgccgcttcgtgcatgaatgtgcgaatctgttccacatcgtccagtttttccgggtcgcagttgtagaagtctgcaaggatgtgatgccctaagggaaggtattgctttttatccgtattcccgtttttgtgcagtctgtcgaaaaccgtagctccgcatacattgcagccttgttttttcaactccctgatggtctgatattccgcctctttccccacggcatagactttgccgcattgccggcagcggtaacggttttgccggagattgcggtctgcggtgtagatgtcatcgcgccctcgtttttcgagaggaaacaaggcgcgtgtacgttctgtcgtttccaggacaaagagctgtcctttgttgcccaaaagagatgcgcccatgtattcattgaaccgggtgaacatctctttgatggccagtccgtgcagttggaaacatttttgcagaaagtaaacctccgttgccgacttgttcccgaacgagaaaaagattctcaatccggactcttctttcagtacgctaatggcacgtgacaggaacaaggaagctccctcttgcgtataaggcggatcggtgaacaggcagtcgaaacgcccgcacaaatgcggaggcagaggcatcctcaaatccacccgttcacaacttatcggcagggcgaaccgtccggccagccgctccagacactcgatataacgaccgtccatctcaagtacatggatgtgtgtcgggcagatgcttggaccgggataaagttctttcagcagaaacccgatggcaaggctgacaaaatcatcatcgcccatgcatacgatttgtctgcctgtcaatgtgccgtttgccaagcagagcaaagccctgcggaatgctgtctgtacggtacattgggcttggtccagtgctacatccgctacggggcgttcgtcgaatgccgcacggtattttttactcagcgcgtcagcgtatgcgtcccttgcctgttcgctttccgccagtcggcgatacaggcagaggtcaatccccttgaatccaagagcttgttccacatactcctttccgttatgagtaagccctacgcctccgctgcattgttccaatatgcccagcctgataccttcgttctttatggcggtcacgataggtaccggcaagagtaatttttgagagagggctttgttggaaagtggcgcaaaacaatacagctcctgaaaataaagttcaataatccgtcggctatccttaattgatactgtcttaaatattttgtcgatataatccatttattacatatcgttgatttacaggctgcaaaaatagaacaacatcattaagtaatagagagcaaaatcctgctgatatgggtacttttcaatacaaaggcagataggttggatatatggccagacggctcaggacttcatccaaacaaaaaccggtataggcggctcaatgaacgtacaggaagcggaggagtttaagacctcgaagttcttctgcaaaacggatttcgacatgaaggaaatcaagaagggggaagcggcgtatgtaccgttactgaagttccacacgttcaagtcgagggaggaacaggaacgcattctttatcggaatttcgtgaatgtgggaatggaggtaaaagaaatgataaaggacgtgctgaacaaacgggaaactaaatagaaagccagattccgatatgagggaactaaaaaacgcctgcaatgattccgtgattattgcggacgtttcggcgtttcctatctattgtgaaaatcttatagttcaaaatcagcttcttgcggccctacataaaagaagggaaatcaggtgttttttatataacgggtacatttaccagtccccctttttttgtataatacctgcatcttccgttttggagataaactcccgaacctgtttttcggacagtatatctgcgaatatttccttgaggacagcccggttgatacaaccatttttacggaaacaacaataaaatcctttcagtcttttaccgcagtttcgacgggagtttatgaaaataaagtcgtatctttgcactctctatcaaacagataaatccatgtgaacaaagggttgaacggacatatcgccatgctttcgacacaaattatttgtggtttgaatgtacctgtcggtaaatcgctcctggcagagtggatgacaccgattgggcttgcctcctctcgtgttttattcgccacgctgatattttggacgatcgggcttgttttcaggagagaaaaggtcaatgccaaagacttgatggtgattgctttgggcggtatttccggtgttgcttgtacttatctttcctttgcgtggggacttaattatacgacaccagttcacttcgcacttattgtcgccttaaatccaatcgtagttatgctcttttccgtattgtttttaaaagaagctatcaaccggcggaagttgacaggtgttctgttgggaattgcaggagcatgggtcttgatttcacaaatggatattgccgcatccgttgaaaatcatatacttggcattgttttcgccatcgtcaatacagttatgctcggattttatctgattatcatccgaagagtggcgataaaatactctcctgtcacacttcaaaaatggatgttcctatttgcagcattgtccatgctgccgttcagtataaatgaattgtacgtgcaaccgctttatcagtccgcgttctgttggcaaccattactccagcttgtattcgtattgttgctggcaactgttctcaacaatctgctatatcccgtcgctctcaaggggatacagcccaccactgccagcatttacatcaacctacagcctattatagcttctgtcgttgccattttaatcgggcaggacatttttagctgggatgaaccggtttcggccatacttgtcatatccggtgttttactggtcagtcattcacaaaataaaaaataaagctaatttgcggttctgtattcattgggcgtacacccggccattttcttgaaccaacggctgaagtgttgcggatatggaaatccaagttcataggatatttcacttatggacttcgccgtattgaatacccgctctttagcgacatcgagcattttctgctggatgtgtttcagggcaggcattcccgtttcttttttcatcaggtcactgaaataattcggggaaagacaaagtttgtatgcacaatattgcacagtcggcatccctccatgccttgcaggggcatcagaggcgaaatactcatccagaaggtcctcgaaacgcgctaacaggtcgtgattggcattgtcgcgggtgatgaactgacggtcgtagaagcggatgcaataatcaagcagcagcttgatgttatccacgatgagcgaacggctgtgcttgtcgataggatactgcagctcaatgcgaattttttccatacattctataaccgtccgtctttcttgtttggaaaggtgcagggcttcgttggcattgtaagaaaaatatgaataatctttcattatatgcgccaatggtgtacctcgcagaaattcgggatgaaatgcaacaacccatccttcgggctggtgcagctgcccgtcatcttcagatcccattacctgaccgggggcgaggaaaagcatcgtcccctgctgataatcgtatatactttttccatatttaagatttccacagttcgcatctttcaatagaatagcatagatgttatacagttttttcccgaaccggagaggcttccctttactgccttcaataacgctgaccaacgggtgcagggtctccacgccaaaatagtcgttgtactgctggactgtatcaaccttcattatttcactcataatttcctcttttttaagtcattgcaaatatagctatttttctgtgatagcttttcattctgcttttaattaaaagcaaagatacggattcccgatggtacggcatataccgaaatcatcgttttggataccaattttactggtataccggcatcgttcttaccggcccgttgaaattggtaattccatccgtgaaattgatacacaggctcttaattcccctatctaattttgcaatcagaaagataatcaaacagataacgacatgaaaaaagaacagattcaagagaacggcatcagtcgtcgcgggttcctgaaacgaaccgcattggcaggcgcggccatctgcatcgcgccggcattggagaaagtaacggccgcggaaaaagccattacaggtaaatcgtcagtatcggcagcaaccattccagcaggaatggcagcagtccgcgcacagcgtaccttgagcagcggcaaggcagcctttaccatttcggcgatgggcttcggctgcatggggctgaaccatcaccgcagccagtctcccgatgaaaagacctgcatccggttgattcacgaagcgatagaacggggtgtaaccttattcgatacggctgaaagctatggctaccacaagaatgaaaaactggtaggcgaagccctgaaaggctataccgaccgcgtgttcgtctcttccaaattcgggcacaagttcgtgaacggcgtgcaggtgaagaccgaagaggacagcaccccgacaaacatccggcgcgtatgcgagaactccctgcgcaatctcggcgtggagacgctcggcatattctaccagcatcgcgtcgaccctgcgacgcccatcgaggtcgtagccgaaacatgcggcgagcttatccgggagggaaagatactgcactggggcatgtgcgaggtcaatgctgaaaccatccgccgggcgcacaaggtatgtccggttacggccatacagagcgagtatcacttcatgcaccgcgcggtggaagaaaacggcgtgctggcgctttgcgaggaactgggtatcggtttcgtgccgtacagcccgctgaaccgtggtttcctcggcggcatgataaacgagtacacccggttcgacaccgccaacgacaaccgccagacgcttccgcgtttccagcccgaagccatccgtgccaacacgcgtatcgtggaggtactgaacgctttcggacggacgagaggcattaccacggcgcaggtggcattggcatggctgctgaacaggaggccttttatcgttcctattcccggcacgaccaagctctcgcacctcgaagagaacctgcgggcctgcgacatagtgttcacgtcggaagaagtgaccgagctggaaaaggccgtggccgcaattccggtcgtgggaagccgctatgacgctttgcaggaatcgaaaatccagaaataggaagggcgtatgagaaaggttgtcttttatatgatggccgccgccttgctgtcgggttgcaacgcacgcaacgggaatatcatgcaaatcgaggaacagggcagtttcgccgtgggcggcacggtgctcaccgattcactggggcgcacctatcacggcgaccacgcctacgtgttctatcagaaacccgtcgatgcccggaaatacccgcttgtcttcgcccacggcgtggggcagttttccaagacatgggaaactacgccggacggccgcgaggggttccagaatattttcctgcgccgcggtttccagacttatctcgtcgaccagccccgccggggaaacgcggggcggagcacgacacccgcgaccgttacccccgtcttcgacgaggagacgtggttcaaccgtttccgcgtgggcatctggcccgattatttcgagggcgtgcagttcagccgcgacaaggaggctctgaaccagtatttccgtcagatgacgccaactctcggccctcccgatctggatgtctacgccaaggcgtatgccgcactgttcgacaggataggtccggctgtcttcgtcacccattcgcagggcggaggtgtcggatggcttacactgccgcagacaaggaacatccgtgccatcgtcgcctacgagccgggaacaaacgtgccttttcccgaagggcagatgccggaggaagggaaagtactaaccctgtcgaagaagaccgaaggcgtggaagtgccgatggaagaatttctgcagttcacgaaaatccctatcatcatctactatggcgacaatctgccggaaaccgacgaacggccggaactgtacgaatggacacgacgcctgcatctgatgcgcaaatgggctgccttgctcaacgaacacggcggcgatgtcacggtcattcatctgccggagataggtttgaagggcaacacccattttcccttctccgatttgaacaacgtggaggtggccgatcacctgtcgagatggttacatgagaaaggactggattgagaaggcggagtcatggacgaaggaactttctgaaaatggcgggaatagccggcggaacgatgactgaaaacgactattgagttaatcgaacaacctttaacaattttcatatgataccattatttatcggaggcatcggtatgcaggaagtgctgctgattgcattagtcgtcctgctgttcttcggaggacgcaaaattcccgaactgatgaaaggcatcggcaaaggtgtccgttcattcaaggaaggtatgaacggcatggagaaagaaatcagtcccgaaaataccgacaagaaagaggagtgacatggcaaaggaagacaaaacggacggcttgaacttttgggagcacttggacgtgctgcggacggcgattgttaaaatcgtcgccgtggccgtcgtgttcggtatcgccgccttttgttttaaggaaaaactttttgccgttatccttgccccgaaaaacgacggcttcatcacgtaccgtcttttcaaccggattgcagcatgggccggcggcgagaccgggagttttgccgtgcagctcatcaacacgggactggccgggcagttcgtcatccacatgaagacggcattatgcgcgggtgtcctgtgcgcgtcgccctatatcctttaccagttgttccggttcgtgtcgcctgccctgtatgcctgcgagcggaaatatgccgtgcggatagtcggaggcggctatgcaatgttcctgatgggtgtggcggtcagctactttcttattttcccgctgacattccgtttccttggaacctatcaggtcagcggtgaagtggagaacatgatcgtcttgcaatcctacatttcgaccctcgtgctgatgtgcctgacaatgggtatcgtgttcgagattccgattttatcatggctgtttgccaaattggggtttctcaccgccgatttcatgcgacgttaccggaagcacgctatagtgattatccttatcgttgcggctgtcatcacgccgacttcggacgtgttcacgttgtcattggtcacattgccgatgtgggttttatatgaagcgagcattctggtcgtaaatagagctgcaagtaaaaaggcagtagacagataaagaaacgacatcttgaagtgaaaaacaatctgccggccaaaagataaaacaaacctttttacaataagaggtaaggtactgtaacacgtaggtaatccgttttataaacggcaggtttttattcgtttctgcattatacatagaaaagccgtaccctgctcgttttccgaaaggcacggctttcatcccctaaaaagaggaatcagacagtgacaacagttacatataaattctgtcgctcctgttcgcagaatttatcgtactcggctttgtccgtgccgctctcgatagcccggtcgataacgtctcccaactcgtcgaaacaaacctcttcgttcacacattccacctccattcctttcacaagatagacctcgtaataatccgatccgttgagtgcgacgatgacgtaccctgcgtgcagccgtccgttcaccttaatgcggagtgccggcaaatccctgtatagggtggcggcaaactctttgataccccacgacatgaggacggtcatgggggttaacgctactaactgttccttaatggtctgtgcgacctgcattacatattctttttccataattctaagtttataaattattattccatgatttactcgaaccaatcggggttatcctttttgagttcggctatcaactcgttttcgggaagctgaagcgttctctcgtcggtaaagaagaaaatctcgtcataaatcctttcggcttctttactggcaaaaccttcgttctcgtcattgaaactgccgggctgcaaggcatcgagcaggattgtcgaaccgataagcaattcttcgccatcgacagattccacgatgcgggagtaataagacctgccgttgaattgaatcttagttgttttcatatcgtcgtttttatattaatggtacattttttccgtgttcattgaggtattccatgatatgcttcgcttcctcgtgcgatgcccggttccggtcatcgtaacggcgtgtttcgtccgccatgaccttgatacacgccttaatcaggcggtacaggctttgctgaagcgtcgggtgcatgtccgggattgccgccgcgaaccgttcggggttgaaactgaaactgtttaccgccatttcccagtctttggcgaggcggtattctttgctttctttaatgtccatattcttgaattttaatagttctcgttgcatattctgtcaagttcctcaattatgggtgtcacctttttgcctgtaagactttctatgtcatacagcaagtgctccaagcgttcatacgccttttctcccgcttttgtaaattctccggtactgtcgaatgcgctaccttcgcagcccagttcttgcaataattcttctaatgtcttcatttgttaaattttaataattgtttttctttccctctgttcggcttccttgttgccggagccgcttcgggttttatggtgctttccggggctggcgaaaaagccctttccgacgttttttcttgccaattacgcttcgcagaaggaagaatttgcaagaaatgcacttcaaaacgacggaatcaggcgcgacagcccatatttgcaccgataaaaaccggtgcggtgacggacgggaaagccagacgggagagaatacggagacctgaaagcggtagaaaaggacggctggaagctaaaaaagagaatttatatatctatatatggataattgttgttatatttgcatataaatagtgatatattgacattatggaaacaacgaactataccacaaacagcgatatgctgacgcttttggcgaagcgggtcaaggagtaccgtctggccgcccgcatgagccagaaggagctggccgaacagtcgggtgtaagccagacgactatcagccatttcgagcagggggtcagccgtaacctgaccttggccaatttcatctccctgctgcgtgcgctcggtcaggcagagcggctcgcggagattctgccggaacttcccatgccgccgatggcgcttcgggaaatcgagaaactgatacctaaacgagttaggaggggcaagaaatgatagaaagtctcgatgtaatcctatgggataaaaaggtcggcacgcttgtcgccaatcgggaaggacaccgcagcaaagcctgtttctacttcgacagcgattatgtccgcgacggctacgacatcgccccgctccgtgcgccggtaaaaggggttgccgcacagcgcggcctgccggtctatcccgatgaagagcggcttttcggcggcctgccctcgttcatagccgattcgctgcccgaccattggggaaacaccgtgttcaacgaatgggccaaagtgcatcatatccgtatgagggacttgtccgccctcgaccgtctcgcctatatcggacggcgcggcatgggggcattggagttcgtcccgcccactgccgaggaactggagacaccgttcaaggtggagatcgctgacctctaccaactggcccggcaggctttcgaggaagccggacggttcaacgtcccggtatcgggcaacctgatggtcgaaagcctgttcaaggtaggaacgtccgcaggaggacgacggcccaaagcggtggtcaacgtcaatttcggggaaggacaatgttactccggacaggtggcgaccccttatccgggctacacgccgatgatcgtcaagttcgacgaacaccagaagatgccgacgacacggatagaatacagttattacctgatggccgtagacgccgggcttcagatgatgccgagccgcctgttggaaggtgagcagacagcgcacttcctgaccgagcgtttcgaccgccggaacggcaagaaggtgcatatccagacattggctgccatgaacccctcggcagattcttacgaagcactattcgaggcggcctgccgtatcggcgtgccgccgggggaactccggcaactgtttcgcttgatggtgctgaacgtgctgggcgggaacgtcgatgaccataacaagaatttcagcttcctgatgggcgatgacgggcgttggcacgttgctccggcctacgactacacgttctcggtcgatccggacgcaccgtattacgtcaaccgccacagcatgactatcaacaaccggacagagggtattactgcggcagacctgctggaagtagcccgccggtacggtataaaggccgcagagccgttcatagaaaagaccataggcatcgtttcgcgttacccggaatacggccgggaggccggtgtcggagaggaatggataggaacgatagaaaaggaaatcgctgcacgagtggagtgcgtgcgagccgattaaaatagagcatgggatttcatgcaggggaaatgaacccacccgtttttgtggcgggtgggtttgtcgttgtcattccgcccctttcttgcttaggagggtcaactggtcgggacggtcgggaaaccaataggcgtcgctgtcaagatatacgcatctgtcaccattccaaggcttcctgaaagctaatacctcttgagggccgaatactactccataatcgtttgtaaatgctaccatgtcgcctacggccaaatcgtcctccgtttccatgacttcggaaaggcgattataaaactccatgccttcggcttcacgttccgctttccagcgcaaaaaatcctctttatgacttctgcccgtgtttatcggcgataattccgaaggcaaaacctccgcttccgaagtaccggacgaaatcagaataatgctgtcgtcttccatgttttccggtgcagaaatcactcggtaagccccatcggacaaaccgttgtccgggtcatgccaataaagcagattccctgtcttgataaaatcgtattttcccattgtcttgtgaattattgattatttatttcccttttttcgatccttttcctttggaaccgcttcggggttttactgatgcagtacacggtcgtcggcacagcttcatacgacggctcttcttgccaattacgcttcgcttgggaaggaagaatttgcaagaagtgcacttcaagccggagaatcaagcgcgacgaccgactttcgcatcggataaaacccgtgcggtgagggacgggaaagccggacgggagaaacaggcggctcgtgccgctacaaaagggaaagaatgcaattataagaggaaacgggcggtggcggggtatccgggaggctgactataaaaggacgaaggcgggcgataaagacaaaggagatagcgcactgactgtgttatcagtacgccatcttgtacattcaatcttcggaacccgacactttcatttttgggaacaatccttttcaaaagcattcttctccgaatggctcgatgttcgctttttggaaaatttgcgggttatgctgataaagaagcggcaggttcaacatagccatagggtattccacgaagccgctcctgcgtttgtagccggaatcggtcgccaatctgttttctaccaaaaagtccaacgcatccgggtaattgttcacgtcgataaaggtacggtccggcaaaccgagcgcatccatttcctccaaattgacggaaagtacgatatattcgtcttcatcttccaccattaccaagataagagccaaccagccattgcgataaaaccgtggtacgaggtaataccgttcgcctctgaactcgtattctttctgtctgaaagagctgtccggctctacgatttcaaattcatcttcacctgcggtaaaagcaatcatagggttgctggcatctacatacgcttcacctgctttgtagcacaaatactctctgttttcggaacgcacgatagcaaattgaatttccataaaatcttaacattaatcagttgaacaatctgtttattttttccctcctttcggaagccttcaggcttctcctgtcgggatttgatttttacgtgcattaaagattgcctttcagggagaaacaggcaaggaatttgggcagaattttatagttgcggtattgagcgtccgcgaaatatggacgattgaaaatcgggaaagctgctgaaaaattgtgttcaaatagcgtagcggtacttgaatgttcctccaaggcaatacctttgcaccggaaaaagcatgtcccgacgggcagagccgttggcgaagggatttccgtacaaaaggaaaacgaagggataaaaagggagatctgccaacggcagtgctaaaaaagacagccgctcctgcggctctctctctgtagcgttgcgctatttcttcccggtcttgctatccggttcgtcttgccgttttttcggggtgaacagtccattgaaacagaccgtcgtggcaaaagtacgtgcctgcgtggcattgcacaatcccgctccgggcattgtcgcaccgttgtaatgtttgcagtccttacatttcatcattacctcttttgattggttagacagtaggacggatttctccgtcctactattgaattatggtcaagctgcgacctcttcgggttgcgtatgttcttcgggttgtacctctgccgtgggttgtgtattttctgcctcggcggcttcttcgggctttgtctgccgttcctttgccaacaaggcggctttgcgttcctcgatacgtttatggcgtttctcatacacctcattatatccactttcaatttcggcgagcgtgtcgggcatgtgcttacgggcaaaatcgagcaagagggtcgcagcagcgttattgccgtatgcgcctttgaagttgtctatcaagaaatccctgcggataacggctttctgcttggccgtgaggttggcgatgatgttcattttttcttcgtcctcaaggtgttggtaggcttttttctccccgataccgaataccccgaagtgttccctgcggagagacgacagcaggaagaaatatatcatcttttcctcgtcctgcgtgaatttgctttcagacgtatcaacgtccaaaatctgtttcttagcgtctgcaacggttttctcgacggctatttccttgttacgtttgtcctgctgttccaatttttccaccggggaaagttgtttttcggtagccatgtccgcattggcggcagcacttgccatgtaacacagcgtaatttctttctgcccgatgcagatataaaacgtgagttcgcccgtatcgattcgttcatgaattgacttgcatttttccatatagttgctgaaatcctgctcgtactccttgtatgccgcctcgtattcctcggtagtgtcgtattcttccttttcgggtgctaccggcgtttcggggtatgccgtggcataggtattgaggtgctcgacctcgtaccccatagcggtaaggcgttccaccgcaagcatgttattgttgaaatcttggtagcccaatgatacggaggggtattgttccacaaactgcaaggctttctccacgagataggaagcgttcatttcggccagacaactccgattggcgcaatttccgcaaccaccctcgcagaacaacatcatgttgttggtattgtgggggcatgaggcgcatagggtcttgtcgaatgcgtaacggctaaggtctgtcgtgaaatcccgttcgataaactttgccacatcggcggctttcagtcctcgccaacagtcgtacaacatgctgtcgctgtctttcaagtgtttatagtacacctctttctgaatgtccgtaccgtatcggcaaatctcactcgctacactgattgtgatttcgtccttttccagaagttcggcgatttcgggtatcaatgatacgaatttcagacgggtacggatatagttctcgtttttgccgaactgcacggccaatgactgcacatcgtagcgaccgctttccatgagcttttggtaggcgttggcttcctctatgggggtaacgtccttgcgttgcaggttctccgtcacggccatttcggcggcggtctcgtccgaaacatgcaagatgacagccggaatttcggtcagttctgccataagggcggcacgatacctgcgctctccgaaaataatctcgaagcggtcggtgtccacaatggggcgcacgccgataggttgcaatactccctgctgacgaatactctcggccagttcggcaaggctcgcctcgtcaaagtgcttgcgtgggttatagttgctcggttgaatattcatcaatgcaactgatacgatgttgttctctactactgattgaatgttcgctgtttccataattcataaattttaatttgttattacattagattgtttgattactattgtctttattgtgcggtgtcatactcgtatatttccggattgtcgtacccgtcgaacactatccgaaacgtgtcaaagtcctttctgcccgccagtctgacggtatctcttttcccgatgaaatagggttcattcattgtccgaaacggtgcgccgagcgttatcctatccaccaacgtacaaactttgccgggttgttcgggcatgatataacccagtgcgtactcgttgtaaactaccaatttgattttatccatatcgctgtcaattttacgttgtttttttctttccctcctttcggttcctttctctgcctgaaccgctttgaggttttacggatgcggtacacggctgtcggtacagcttcatacgacggcttttcctgccaattactctttcgcagaaaggaagaatttgcaggaaatacacttcaagccgccgtatcaagcgcgacagcggacctttgcatctgataaaacacaacggtgacggcagagaatgaagccgggaaagcggtaagggaatcggtagaaaagggatatgcccgtcagggttagaatagggataaaacgggccatgtgcctgtacttgcgggcaggtaaaaaagagaaagatggtaagactataaaggaggaatgcgccctatggaaacagcgggcggataaaaaaggacgcatggctgccgtctccggggtgggcagacgcggtagccatgcctgtgtttattgttcgttcttctccagatactctttcattgcctcgttcacgatgtctttcagcgacatgttcttcttgatggcgaggaatttcatacgggtatgaatgcttttgttgatgacgaagttgcaatgaaccgccgtttctttttccgtgggggctgctaccggctgttttccgccggtagtctttttcgtaggtgacagcaacccgtccagtccgcctttcatgctgtctttcagtaaatcgctcttgctcatatcgggattattttaatttcagtacctcttgcgccagtgccatgtagtccttggctccgttgctgttcctgctatactcgaagatgttcttgccctttatgggagcttcggccaaagatacgttatcccgtataacggtcttgaacaccttttcgcagaatgaatccttgacgagttcggccacacttttgttcagtgtcttgcgtttgtcgaactgggtaattacaatgccaccaatagcgagtttcggattcaggcgttcctggacggtggcaatcacattcatgatcttggccatgccgcgcatggcgaggaattgtgcctgtaccgggataatcaggtagtctgcggcggtaagggcgttcagcgtcagcaaccccaacgagggcggacagtcgataaggatataatcgaatttccggttttcgagcaacttgccaatcaggccgttcaatatcagttcccgtcccggctcgttgatgagttctgcctcggcagccgagaggtcgaggcaggacggtacgacggttacacctcctgccgtttcaactaatggcaaggggtatttgcctttcatcgccccgtacaccgtctgttcttcctcaatggagaggccgaaggattccgtaaggttcgcctgaccgtccatgtcgatagccagcacgcgctttttcttttgctgcagggccgcagccagattgatggtggtggtcgtctttccgacccctcccttatggttcaagaccgcaattatttttgtcatcgtttcactcttttattccacttgcaaagttaatactatttttcgtaaatactaaaattagtatatactaattcactaaaaactattgttttagcagtgtagtattttagtatttactactatactaaaataaagtttgactaagagtagtatatcctacattcgcagacgagtggcttactaatctactacatataggatatactacatttagtattcgcttattttcaaaggtttactctcttatcagaaaggcaaatcctccttttcgtcctgcgggaaatctgcaggaggaacgggtgcgccgtctgctccgcttactgcattgtcctctccggctgccgcgccttcccgccttccggtattgataaaggcaatactctctgccgtgatggagagctgtatctggctctcgccgttcttgtctttccacagggaagatgacagcgtgccgtcaacaagtatgagtctccctttcgtcagatattcggacaagcggatatggttgtccttgttgctgcgtacccttatccaagtggtgatgttttgcccctttgaataatcgtcaacggctatgtccatagccatgaatgagccgtgtgctcctgaaattacttggcaatctttgccgatgcgtccgatagtgtgaacatgtaacataatagaaaattgtttgtggcaaggtggttggtcctgccgttacctaactgtttattttttccctcttttcggttcctttctctgcctgaaccgttccgggattttatagatgcggtacccggctgccggtacagcttcatacgacggcttttcttgccaattactcttcgtagaaggaagaatttgcaagaaatacacttcaagccgccggatcaagcgcggcagcctacctttgcatctgaaaaatcggacggtgacggcagagaggagaccgtagaggttatacatataattgatataaagggaagagggcttcgcccaagtataagagcagaggaaaagagagaggtataaaaggaaaccgccaacggagttgcggtaatttacaaacgggtatcgtgcccttcaccgacgatgttgtcataggcacgataccttatcatagcttattttgtcagaaccggtatctcaaagggaggaatgcagcaaatcgcccatcctttgttctggcaaagtacaaaaccctctgacgatagtatctccgtttacgccttcaagtccggcgaacatttgtaatgcgtcaaaccctctgtcgaactgttccatgatgacggcgggggcaaaatggataatcccgtgagggtagcttttcgatgtgccaatccacccgcgcaaataatcatcgaaacagccttctgctcttgacgcatggaactcttgtgaatgggaactgcaaatggttttaccgtagatttcgtctcctaaaattaaagttcccgtttgcggattgtacataaaacgccgattggttatttgaagaatatctatgatttcccatttgacattgataaccatcaggattttttcaacctgccttttcatgcgtttgcctgttttacaatttttcttgtccatcacttgtcttttatgccgtgaaacatctgcttttttacccttttttcgattcttctctctgtctgaaccgttccgggattttacagatgcggaacacggctgccgacagggcttcatacggcgggtttcccggccaattacgctttcatggaaaggaagaatttgcggggaatgcacttcaagccgccggatcaagcatggcagccgacctttgcatctggcaaaccggacgacaccggcagagaggagaccggaacagaccggtaaatatgatggtaaaaagggagtacggctttgcctgtataaatgcaggggaagcgaagtagaaaagggtccggcttgggcgggtccggcaagggtctgccggggcaaacatgaaagggattctccttatccgctccacgcctgaatttcgaccgggcggaatgaaagcgcggagcgaataagaagtatcaccgtttgcccttgacgtggcaggtcacaagggaaagatacggaacagaggcggaaagtccgaaaccagcggcataaagaccggtcgggctgtggaataccgtgttgtttcgacaggtcgaagctccggcatggaacggcacgatccgggctgccgccggttttgaacggcctcccgtacctttccctgacgacttgttacggcacagactttccactggttcacggggttgggaaagccggcgtataatagggaaacagcctgaaggtaaaaaaggagtaatcgtactataaaaggtatcggttgccccgcaatccgtccggagggctttcgcccatcggacagaccacagaggttatcggcttatagtttgggcttgttcttcgggagaatggggcaagaaagtattattctgtaaaatggccccagctcggtctttaccgggtctttcgataccaagaatgttgcgctctccttgaccttcgctatatccaaaatggtcttacagatgtacttattcctcaaacgtgttcctcccctgttgaactgcagcggaaaacctcgcttgtcagtggttttgtgcagaaaccactctttcgggttgttttcatcacagccaaactccagtcggtcgttcattgtgatattcatttcttttgccaatttggtggatagatacatgttgccggtaacgctgttgaaccttatgcttcttttacctacacggttttctcttgtccggcaattctcgacgttgtaaattacaaatttcattttcttgaattatttacgggttatacaaattacatgcttacgtgggcgtaccttttggaaaatccttcgtgattgcggatagtgtcggttatatcgcttattctccggtgtatcgcacttgcggaaatgcctgcataggcggaaaggtgtctgtatgaacatttcgcctcgtactctttcagtctgaaaagctcgtagtccgtttggggatatttcttcttcacaaacagcagtatgtcatacaccagcttgtcggaagctgccagcacctcgacggacggtgtttcttcttcctgcatgagcaaaaagaaatgttcgttgtcggggaaacagtaacaactatccttgtgaatacatttcagtctgcactttttgtacacgccgaaaaaataaggctcgaagctctcgacaggtatttccgaaatcacgacttcccgtttcatcgccaaataggcgtcgtgaaaggcgtcctcgtgcaggtaacgtccgaatatgttacgcaatctctgatagttgtaaacgaaccagttgtcaaaaagcgaattttttttcatgtttcaatttgtttttaagttttttttatttccctccggttcgagcgattaccggaaagttcgattcttttttctgcctcgtctttgcatcacggggtttgcagcaaggattccatgaaaaatactcttggaatggaatgagaaggaagatttttcatcaggaaaatcgaagatgggccttgaggcaaagttttgagatgcaatcaactttgcggaaaaaagtgtcgggctttacggtcgtcggttcgtgatagcatctcaatctacaaaggggggggaagcgaaagcctgcctataaaagacaaggtgtgtggtataaaaggagtggctggaggtacaaggggaagattccgttacaaccgggtatggccgtggcagaccggaaggtgaaaaaatcccctgtccggtgttgtaaccgaacagagggaaaaggttaaatctatgaattatggtcatgccgctttgtcggtggcctcgtgttcggaaagggcggactgcgtgcgttccgcctctttcatgctttcgtcgatccgatgctgtaaagcgttgcactcctgtttgagccttgccaactcgtccgccttgctccacttgcgggcgatgattccctgcaaagcgggtatctcgctctccagcttggctatcttctgccgttgttcctcaatcatgccgggcagcttggcgagggcggcttgcgggtatcgggaggattccacgaagcccagaggcaatgctcccgatatgccacaacggtatttcagtccgcttacgccctcgacgaggaacgtgttgcggtagaatgtaccgcccatgtcatactcgctgtacaccgacaggttcaatccggcatacgtgcctatcgtaccgattgccccgttgcggtaggtcttggaaatgcggtgcagctcccgtccggtctcttccgccgtggcttgtgcgaggttcaacagccgggtcgtccggtctccggtgtaagaggtgatatattcccagtcctgcgtcatgcgtgccgccgcactctcggcctttgtcatgtcttcccggttggccgcaatcttacgctcggccctgatacggtctttcttgaaaatggcctgttccttttcgagctgcataatcttattgtcgagcttcgttttctccaacaggtcggtatttcccgacaggagagccacgaactcggcgaaattcatgccgttatcctcgtccatagcgtcctcgtcgatacggcgcacagcaatcgtaccgttgttaatttggttgatgaacatttgcttggttttcaacaggttaaatttgtaagcgtcgagcgtcttttccgttccgtaaatcaccacgtccacggtattgtttccccagagcttaacggtgttgcctttgcgtaccgcacgaccgttgcgctgctccatgtcggcggggcgccaaggtatctccagatgatgcaccgcaacggccctttcttgggcgtttactcccgttcccaacatcgaggtagagccgaacaacacccgtaccctgccactgttcatgtccgcaaaaagtttctttctcgcccgttcggtcttggcgtactggataaactggatttcatcggcaggaatccccattgccaccagcttgtccttgatgtcgctatagatgttccactcgttcggcttgtaagtggcaaggtcgctgaagacgaactgtgtaccacgattggcatttgaacttacataataatcataaatagttcttgcgcaaatcgaagccttgttgttcgggtcatcagtaaacttatcgcccaacagacgcatatcaagagacatcttacgggccacgttggtagcaacaagcatttttgccttgtcgagattgtccggctgcggaatatccaaccccaaatcttcccattgtccgctgtgcgcaaaggcgacgagccgcccgatcatttcctcctgttggatagtgggtgcatgggaaaggaaacgcacgtttttgtccggcacatcgaggtttatcatatcggctgtacgatagtcggtaatctcccgcaggaacatcgccagttccggcactttgatgtaagtgcggaaacgctctttgcgctttatcgtacccgttacgttcagctcgtagtcggcggcctttttcgtgaagatagccgcccaagcgtcgaaacagcttacttgttgccgtttgagttcccttggacgcagatatttgaacatcacgtacagttcggtcagcgcattgacgaccaccgtacccgacaggaacgtagcccccaagtcctttcccgtgcggcgttgaatgtcccgaatggcaaacaaaaggttcatcgccctttgcgagccttgcgcattgccgatgcccgctactctcgtgtggcgtgtctggaacatcaaatttttatagcagtggcattcgtctacaaaaatgtggtctatgcccatcgaacggaaatcgatggtatcgtctttccggaggtctatcttcatctgcagttcggcgagcttggcttcaaggttctgtttccgggtttccagtcctttctgcatcctgccgctccggtaacgcatagtggattgctccagcacttcgaggctgcgctccacatcggccagttcttccgagaatatgtcgtacatggtttcttcggattgcggaatcttgctaaactggtcgtgtgtcaggataatgcaatcccagttgttgttcttgatttttgaaaacacttccttgcggttggcgggggtgaaatcttccttgcccggatagagcaccttggccgtggggtatgcctttcggaatgtatcggcaatctcgtgtacattggctttcagcccgataatgaggggtttctgcaccagtccgagacgtttcatttcgtatgcggccacgcacataatcatcgtcttgcccgtgccgacctcgtgccagcagataccgccgccgttctgcttaatcatccagatagcgtctttctgtgagggataaagttctttgtacgggaacagctcgaaagagaggccggggaacgtctgcgccgagccgtcgtagtgcggacgcacgtaacaattgaagcgctcgttgtatgtccttaccagttcgtcccggacttccaaaggctcatcgtcaagccaccggttgaaacggtctctaatttcctgtatcttggcggcggcctcctgcatggcttcctcgtccggcacacgtattttgctgccgttccggtattcctctttcgttatctcaggtacggtatcgtgcagggcgtgtacaaacaagtcctcgccgttgtaattgcgcacggaataggtattgtatgccacgggcgaatatccctgcagccgaatcaagtaggtatcgttcacgtcgaaatacatcacgtccgcacccactccgaataggtcggaggcgaaatcggcgtacagcttcgtatctatccaccgctcgcccatgttgatgtcgagttcttcatagggtatcggttcgggtatggtgttctccagtgcctttgcggacgcttcggcccattctttctccttgcctgcgagattcgggagaaaggaaagcgtctcttcctgcttggcgatgatgtttccggagaggaactttcctttgtgctcccattccccattggccggattgtagaaaatttccccttgcagggcttcgatgatttcttcttcctccttgttcgtggcttgtgccatgtagcccatatcgaccttgccgtaaaagttcaggctgcttgccaaggcttccacgggggacagcgttacggcggtgtctatcttcttgaaagctacaggttcacgcataacgtcggctttgaagatgtccctgccgacctgcatttctatcgtgaacacctccgtaccgaggctgtcgagcaagataaactccttgttgtcgttgtcgtggaaaaatccccatttggcaataaaagcgtcgtatagggtgttgagttgtttacgcagttccgagcactccttttgttcttcccgttccctgccggacagctcgaaatacaccttgcgtatggggaaatagtcggcggccctgtccgtatttaccttgccctcgtccacgggtacgaaatcaacggctgtctccgtgtaacggctcgacttacgaaaccgaagcgtacctacctgcccctcgaaaacgaccattgcgccgttcttcatccatgtttccatgtcctccgtgtaggcacgtatgcctttgaccgtctgcggctcgccgaaaagagacatctgcacgggggtgttgtcctggccgtgattggcaaaaagagccttgcgaaaatagcggtcgaaatcgtatttgagcagtgcggaaaggtattgggacatggcgtttccatcgcctaaccactggtatttgcggacgtacttaccgaactggttcagcgcaatgcgactgtccgtggcaagggcggtcttggggagggtaaagattttgttcgcatagtcggtcatcgttcctgccgtgtcgaccttttccttggagacctgcaaaaacatcttctcccgtaacgagagcgtcgccttgcggctgtgcttttggaatatcaaaaggtcgctccctacctctatgccgctcgtctgcatgaaaagggtatcgggtagccgtaaggccgttatgaggtcggcatgattgacgaggtactcgcgcacgaacttgttgcccggcgtgtcggcaattcctctcggcgcaacgaacgccagcagtccgccctcgttcaacagttccattgccttgacaaaaaagtagttgtgtatggtcttggctgactgttcgtacatgccgcctttcttccacatttccgcatcgaacacccggaaattgccgaacgggatattcgaggcgataacatcgaagctctcatgctccagatgctggtcggctatcgtctcgaagcctgccgttaccgtggtcgcctcgtcatacagaagcgacaggataagccccgtaagacaatctttttcaaaagcgtagctgcgagtgccgggcatggagacgggcagaaagccgccaattcccgcactgggttcaagaaaggtactcatttgcaggcagttatccttgaatgtagcgtgtatctgccgggttactgcgtccacgaggaatttcggtgtgtaaaaagcagtcaggacggaggattttatactgttgatgacggcttgccgcatggcgtcgtcataatagggatatgcgcctatcaagtcctgcagcttgcggataggctcggccacatcatcgctgacggtatgctccgttcctatattcaatacatctttaatccccccgaaaccggaatatcgggataatacctctttctcttcgtcagtggcttgtcggtcgtcgatacggactttcattgccgttgcaatggcttccacgtttgccaccagtgattttaatttgctgtaactcataatttaaccttgtttgtttccctttattcggcctgtttgcggcctccgggattatttttctgcctcttgaaggtggcagggacaatcggacaaggctgaagcgaaaaaatacgctcgacaacggagaggaagatttttgcgcctcactcgcggcgcagccggcattggcaagattggaacggcccgttaccttcgcggaaaaataataccccgcaggtcgctgcaaggctgggcacggaaaccgacagctaaaagagggaggaaaatgcgtacaagggagaaaggacggaacgggtatagaaaagggagaaagcgtcgtacaacggggaatgctgccgacagaccggaaatccggagaagatgggataagacaagggaatcctgtgcataatcaaaagaaaaacttacccctgtaaccgattataatgaataacctatgactgaaaagaatactcccatcttatctcccgaatatctcgatttcagaaacgagataacctcccgcatccggtcgccccaatacgaggcattgaaggccgtaaacaaagagatgatcgccctgtattgggaaatcggcaggcggattaccgaacaacaagcggccttgggctggggaaaatccgtcatggagaacctttcgcggtacatacaaaaggagtttctgggtataaagggattcggtgtttccaacatgtgggacatggcccgtttttataccgaataccggtcgaatgaaattctccaaccgttagttggagaaattagctggtcgaagcacatcgtcattctgaccaagtgcaaagagatgcaacaacggcaattctacatcttgtcaaccaagaaatacggctggacgaaagatgtacttatcaacaagatagaagcaaagacctacgaaaattatctgctcggtcagagcaacttcgacatgaccttgccggagaagataaagaaccaggccatacttgccctgaaagacgaatatacattcgaccttgtgggcctttcgaaagaacattccgaatacgaactggaacaagcgattataaagaatatccgcgcgttcctcatggagtagcgagatattcagttttttctaactgaaagtgagtacagaaatgttatcatagcatggcagagactatttgtcaatccactcttttagccgttgagccttctctttactaacggttatttttgtgttcggatacccttttaagcggacaataagtttccctccgaaataattagaaagaaacaatacgtattctatgttaattatgtattggcggttggcacggaagaagcaatcaggattgagttgctgttcgagttcgtccattgacatattgacaacttctgaagttccattattaagacgaaggtataccgtcttgttttcggtttcgatatggttgatgtccgaaacacgtacggtcttatacccgtcacgatagggcaacaggaaacgttcccgatagcggaactggttcttctgcaacgaatcgaaaagctgccggagattttcgtcagcataattcttgccagctttggtagctttatctatggcagcttcaagttcatcggcatccaaaggcttcagaagatagtcaaagctattgaacttgaaagcctgtaccgcatattcatcgtatgcggtggtgaatatgattggaacggttgccggagcatatttaagcgcttcaaaactcaggccgtcagtaaggcggatatccgcaaggatgaggtctgttgttttgcctgattggaaaaaatcgaccgcctctttgatatttgtaagtggtccttcaattataaacgtcgtatcaatgtcgttcagcaatctaatgagacgcatggcattgcgctgttcgtcttcaagaatcagtatcttcatagggactgtttttttatgatgggcaaactcaccgaatagaagttctcggcattttctatcttgacttttttatcgcagagcaacgaataacgctctattatgtttttatgacccaagccggtcgattccatttttgagagcaagggagatttaaggttgcgcactgtgatatagtcgtcagacaacgtgatgtcaataaacaacggattttccatcgaaaaaccgttatgctttattgcattctccacaagaagttgcaacacggccgggggaaggtatcctttgcattctttcagttcgaggctgatgttcgtgacgacccctccgacgtggcgcacctgcatcagatacaagtatgattcaaggaactttatctcatctctgacgggaatcagattccggtccagattggtgatgatgtaccggtacactttcgacaggttactcaggaacttgccggcaagtttggtatcttcctctatcaattccagcaggttgttgaagttgttgaacatgaagtgcggattaatttgcagcttcagcgagttgagttgcgactgtaaggcaatctccttctccttcatcagtgccatttcaagagcctgcttctcatcgcgcgccctgatgtatgactggaggtagaatgtgttggcataaacgcttgatatgaaagtggctatcatggcaaaagtgtaagcccccttcatgttgatcagttcgtcaagaagcccgttgccggtttcatcccacaaaagattgaacagagatgtcatgccgaacgtaacgaggttattcagcgtcaaaagacaggaagcatagacaatcacccacacataagatgttctgaacggcaaaatcttaaaaacaaggtaagagaaccccaaggatatgtaggtaaagagcatacacaacaaaaaatcgacgacataatcgactgtcgccattcccggtaattggttggcggtttcgtcatcaagaattaaccatataataaggtagaggatataggaaacgagcgatagcaggaagccgttccgccagttcattatttttacattttctttgatcatatttggttgcaaagttacttcatgttgcaaaggtacgactttgctttttcatttgataggtcgaaaccggatgaaacagacaaaacagcagttgaaacagataaaaggagtgtcgagacagatggttctatcatttatactgtattcgatgcttgcataatgaacgtagattgccaaaacagggtatgattttggtaatctgtaggaaggtgacgcatcaagaagcatggcttaactgcccaaagatgtgcatctttgaaaagagcatttacaatgacatttcagaagccattttagctgttttataaatgtttttttccgtttcgactgcatgccggttgtcggcaaattgggtatggaatatctttgcagccaaaattggcgacttatgattattgaaacagaacaccttatcatcagagattttcaggagaaggatgccgttggtttgctggaatacctctcccatccgcgtgtcaactgcttcgtgagcgaacgcttgtgctctgaagagtctgcactggcttatatatccaatactccaaaggagttgctgcgctatgccgtgtgcctgaaggaagacgatttcataatcggtgatgtttttgcattgcgtgaagaagccgacacattcaacgtgggctggcatttcaaccaacgcttcgagggcaagggattggcgcatgaagcggcaacggaatttctggattaccttttccgtgaagcaggcgcacgtcgcatctacggctttgtggaggatgacaacctgcggtcgaaaagattgtgcgaacgtctcggaatgagatatgaaggatgcatgaaggaattcatatcgtttgtgtgccatcccgatggaacaccacggtatgaggacacctgcatttatgcggtattgaataaggaatggaaaaacaataagaacagatgatgaatagaagaacatggatagccggcatcacggtaacaagcctgctggctgcattattgacagcctgcaaacaagaacagagggaacaggaaatgagacagacattgcccgtcatggtggtttcttcccgggcagttgaatttcaagaaagttattccgcctccatccgtgggcggcaggatgtggacatagtaccccaagtgtcgggccgtatcacccgcctgtgtgtgaaagaaggggagcaggttaagacgggacaagtgcttgccgtcatcgaccaagtgccctatcaggcagccttgcgcaccgcacaggcaaacgtcagcgcagcacaggcaaaagtggaaacggcacggatcgagctgcaaggcaagcaagccttgtttgatgagaaagtcatatccgattacgaactctctcttgcccgcaacgggctggcggtagcacttgccgaactcgaacaggcaaaggctcaggaaacggatgcccgcaacaatctctcctataccgagataaaaagtcccagcaacggagtggtaggcacgcttcctttccgcatcggcgcacttgtcagtcccggcatgacgcagcccttcacggtagtttccgacaatgcggaaatgtacgcctatttctccgtctccgaaaacaagctgcgtcagttcaggacacaatacggttccatagacaagatgatttcccaaatgccggaagtcggcctgcaactgaatgacggcacgttctacggacggaagggacgcatagagactgtcagtggcgtggtcaatgccaccaccggggcggtgcaaatcaaagcccgcttccccaaccccgaccgtgagctgctgagcggcaccatcggcaatatcgtcctgcaaggagtggatgcggatgccatcctgctgcccaagaccgccaccgtggaattgcaggacaagattatcgcctaccgcctcagaaacggaaaggccgaagcagcctacctgaccgtggaccgtctgaacgatggtaaccacttcgtggtgaagcaaggtgtgtccgtgggcgacaccatcatcaccgaaggggtaggacttgtaaaggaaggaatgattgttacacctaaaaacgtaaccccatgaatctacgatttttcatagaccgcccggtattctcgggcgttatttccgtggtgattgtcttgatgggactcatcgccatcaaagtgctcccggtggagcaatatcccgacattgcaccgcctactgtcaacgtgttctgtacctatcccggtgcgaatgccgaaaccgtgcagaaagcggtaatcgtcccgcttgaggaagccattaacggagtggaggacatgatctacatgacctctaccgcatccaacacgggcgatgcttccatcaacatctatttcaagcagggtgccaacgcggacatggcggcggtgaacgtgcagaaccgtgtgaatggcgcgttaagccagcttccggcggaagccaccaaaagcggcgtcacgacagagaaacagcagaatgccgagctgatgactttcgcgctttactcacccgacgaccgtttcgaccagactttcctgaacaattacatgaaaatcaatgtcgagccacgggtgaaacgtataggcggtgtcggaaaggcacagctgttcggctcgaactacagtatgcgtttgtggctcaaaccggacaagatggcggggtacgggcttatcccggatgatatttcggcggtattggcacggcagaacattgaggccgccaccggttctttcggacagaactccgacggggcaaacgagtacacgatgaaataccggggcaggctctcgactgcggaagagttcggcgaactggtggtcaagtccctgcccggcggcgatgtattgcgattgaaagaggtcgcggatatagagctgggcgatgagtattacaattattcatccgaagtgaacggacatccggcagccatgatgatgataaaccagaaatccggttcgaacgcatcaagcaccatcaatgagatacacgaggtactcgatgacctcagccgcgatttgcccgaaggggcagagtttgtggtgcttaccgacaccaacaagttcctgaatgcctccatccattctgtcatcaggacgcttatcgaggcgatacttttagtcatcgtggtggtgtatgtgttcttacaggacatcaagtccacgctgattcccacgatttctatcttcgtgtccatcatcggaacgtttgccgtaatgtcactgataggcttttccatcaacctgcttacgcttttcgcccttgtgcttgccataggcacggtggtggacgatgccatcgtggtggtggaagccgtgcaggcgaagttcgacgaggggtatcagtctccggtgcttgccgccgatgatgccatgaagggcgtgtcgtcggccattctgacctccacccttattttcatggcggtgttcttccctgtgggcatgatgggcggtacttcaggggcgttctatacgcagttcggtatcacgatggcggttgccgtgggcatttcggccatcaatgccttcaccctttctccggcattgtgcgccctgctgctgaagccttacattgacgagcacgggaacacgaagaacaacttcgcggcacgcttccgcaaggcattcaatgcggtttttgaccgtttgagccgtcgttatgtgcgcggtgtgctatatgtcattcatcgcaggtggctgctgtggggcactatcgcggtatcgttcgggctgttggtgctttttgtcaatacgaccaagaccggacttattcctgaagaagatacaggcacggtcatggtcagcatgaacacgaaacccggtacatccatggcgcagaccggcaaaaccctaaaacgtataaacagccgtcttgacagtatcgcagagattgaatacaacggtactgtggcaggcttttctttcagtggctcgggaccttcgcaggccatgtcttttctcactctcacggattgggacgagcgcaaaggggaagggcagtcggtgaacgatgtaataggccgtatttatgccgccaccgccgatattcccgatgccaccgtattcgccatgtcgcccccgatgattgccggatatgggatgggcaacggttttgaactgtacttgcaggacaaaaacgccggagacataaccgccttcagccaagtgaccgaccggtttgtggaagcgttgtcgggcagaccggagatcggtgaggtctattcatcgttcgcggctgattatccgcaatactgggtggatatagatgctgccaaatgcgaacagtccggtgtgtctccttccgatgtcctgtcaacactctcgggatatttttcgggagaatatgtatcgaatttcaaccgcttctcaaaactgtaccatgtcaccatgcaggctcctgccgaatatcgcatggacaccgaatcgttggacggcatgtatgtccgtacttccgacggctccatgtcgccgttgagccattttgtccgtcttaccaagaccaacggtccgtcggacctgacccgcttcaatatgttcaatgccatttccatcagcgggtcgccggcaacaggatacagttcgggacaggtattgaaggccataagggaaactgccgaccacgttctcccgtcaggttacacctacgagttgggagggttgtcgcgcgaagaaagcaatacgacgaacaatgccgtgtggatattcgtgctgtgcatggtcttgatatacctcatactgtgtgccctctatgaaagcgtgttcatcccgtttgccgtgttgctgtccgtgccttgcggtttgatgggcagcttcctgttcgcgggactgttcgggctggagaacaacatctacatgcagaccggactgattatgattatcgggctgcttgccaagacagccattctgctgaccgaatatgccggcaagcggcggtcggaaggcatgaccctcgcgcaggcggcatacagtgcggcaaaggttcgcctgcgccccatcctgatgaccgtattgtctatggtgttcggactcgttccgctgatgatggctcatggtgtgggtgccaacggcagccgctcgctcgccacgggcgtaatcggaggtatgatagtaggtacgctggcactgctgttcctcgtaccgtcactgttcatcacatttcaatatattcaagaacggattaaacgtaattaaatgaagaagatcatcttatttaccatatcaaccttgatgcttaccggctgtggcacatacagccggtatcatcgggctgacattccgacagagaagctgtaccggaacatcccggctggcattgatacaacaacgcttgcatccatgtcatggcgggagatgtttaccgaccgtaaacttcagtttttgattgagacaggactccggcagaataccgacctcaatgtggcacgcctgcgagtggaagcggcagaagccgccctgatgacagccagactgtcgtacctcccttcattgggaatcagtgcggaaggcagtggaaacaaatatgacggagctacggcaaaggcgtacaatgtgggagcgtccgcaagttgggagcttgaattattcggcaaacttacggcagcaaagcgtggtgcggttgccgcattgcaaggaagtcgtgactaccggcaggccgtacagacacagcttgtcgctacgatagcggacagttactataccctcgccctgcttgatgcgcaaaaggtgataaatcatcggactttggaaaactggcaggctaccgtgcgcacacttgaagcgttgaaaaaggtgggcaaggcgaatgatgccggtgtgttgcaggcaagggcaaacgtgatgcagctggaatcatcgcaacaggctatatgcaaaagtatctctgagacagaaaacgccttgtcggcgatacttgccatgccgtcgcactcgattgagcggagcgatttggcagaagcgtctttccccgatacaatctctgtcggagttcctttgctgttattatccaatcgtcctgatgttcgtcgggctgaaatggaactggctcaagcgttctacgccaccaatgtagcccgctcggccttctaccccaatatcactctttcgggtacattgggctggaccaacaatggaggcggggtaatcaccaatcccggacagtggctgttcaatgcaatcgcttcgctgacacagccgttattcaaccgtggaacaaatatcgctaatttgaaaattgctcaaacccgtcaggaagaagccagattgttataccaacagtcattactgaacgcggggaaagaggtgaatgatgccttaaccgcatggcagacggcaaaatcgcaatttgaaataaacacccatcaggttgaaaccttgcgtgaagctgtgcgaaagacggaactgttgatgcgccattccggtaccacctatctggaaatattaactacccaacagtcactccttgaagcagagacaaaccggttgcaaaccagctttgaccgcatacagagtattatcaaactttatcatgcactgggaggtggaatataaattagaatcgggtatcgaaaataccttttgacattgattacggaatcagaattgcaatggaagttattagtgggacatggaaaagttgtatcatttttgagctaagcgatggggctaaatgtccgagcaaattacacaaattgtttcctgaagccaatgctcgtgttataaatcagcaattaaagaaattggaaatgtatggaatcatagagaagaaaatatttgcggaacttcccccacattccgaatactcgattactccgataggtgaaacccttttgcctatcattgagaaactggaagagtggggcaatttctttcgtcccaatatggaaaaaatattaggaatgtcagcagacaaaatgtaattcattcctttgcttatatattacacagtaataaattgcataaatacatgaaaacaagatatttcgagaagacattgaaacaggtgaacggcaggtgcaaagctcccgtggcagagaaaactgccggttgtacaggtatgtcggaataaccttatcccaatgaatatggaagcaaagctctggttcatggttttgtgcggccttgcagtcctgctgtcgtatcttgccggtttctggcgacggaagactgcagctgctgcgttcgcagcagcacgagcagccgctaccgccaaagagcgcgaccgttattgccgtctggcggtactggcgggccatcgggaagcctgcctcatgttctgtttcgcccgttcggactttttcgaggaccatcagccgctcaagccgttcaaatcgcacggaataaaagtcgctttctatgggtattactatccttcacggtacgccgacctgatcgacgatgaacagcgggcgttctgctgttccctctaccagttcaaagagggcgaaaatcacggtatcgagttttttaaggcgtgcatgtccgtcttgaatttggccgatgccccttaccacatcctgtttatgccgtgcagcgacgagttcaagtatgcccggcgattcaaacggctcgactggtacatcacaacccaccggccggacctaagttcgggcttatatgatgtcgatgtgttcgagtcacgcgacagcttgcacgaggcgaaaggcggcgaaaaccgtatcctcgaaaggaactaccgtatcacggggaatatcgaagggaaacagattatcatcgtggacgacgtgctgacaagcggacagagtatggccgactacaaggaggagatagaaaggtgcggcggcaaggtggtggcggccatcttctatggaaaaaccgttacccggccgcctctgcttctgataaaggcgcacgtgtggggtggctgcatcgtgaacaaaatcaaggaactgacgaaatgaaagaatgactattgttgaaattcgtttgaacatcatcgggaaaaagccttatcctttttatcaaggggtggtagaaaggggacttgaacacttggaaacggttttggaacattggaaaaagaatatatgacatggaaataaaacttattacttctaacaagaaacaattcttggatttgctgttgttggcagatgaacaagaaagcatgatagacaaatatctggaacgaggtgagatgtttgccctctatgatgacggtctgaaggctatctctgtagtgacgtgtgaaggagagggtatttacgaaataaaaaacatagccgtttgtccctcctcccaacgcaaaggatacggaaaacggctggttgattatctctttggatactatcagggcagatgttccgtcatgcttgtcggtacgggagatacgccatctacactctctttctacgaacattgcggctttcgtatctcacaccgactgaaaaatttcttcacggataattacgatcatccgatttatgaggatggaaagctgcttaccgacatggtgtacttgcggaaagatttctcttaattcatattttgaatggaatctcatttttcacatcatttattataagtgatttgtgattattgaattatatctctatttttggaaacgtaattttaattttcccgaaaaaccaagaataatagggacaagtatttttagtcattacattaaaacattataatttatgaagaaaatcgtattgacttgtgtcctcgttttttcagcctgctgtgtgaccctgtttgcacaaaaggacaaaaaagaaaaggaaacagtgaaaatagaatgttgttgcgaggactgtacctgccgcaagtgtaaatgcgatacggactgctcggaatgcagaggttgtcgcaagaatgaagaatgcagaagttgcgtagattgtgatcatgaaggtcgttgctgcgattatcatcgtcatcacaagaaacacagaagaggcggatgttgcggaggatgttaaacaatcgctgccccaaattataaaaagtgaggttgttcacttcaaaccggcacaacctcactttttatgcgcaaagaggcgatgtctccgtatgcggtcattccaaccaatggaatcttgaacaaagcctcccaaattttcaactggcaatccgtttctttcaaatgccgttttatctctccggtcctgcatgaaaataaacagggcgttctgccgtatgccatcgcattttgtgtagaaccgggtgtgctcaatctccaagagactttcttaaaaacaagtttcattacttgtttccttttctcaccctatatcctgtccacagacaccatacgcatcctcctcccacgaggaagacaaacacgtaagtagccacgctgcctatgaacacccgtccgctgtgtacttccaaagcgaagttccaaagcgacatgggttgtgtggagagttcgccgggctgggcaagtgcatccgttccctcgtaatattccaccacgcattcctttcccttgaaatccgcactgtaacccgaaacggcaaacttgccgaaaggaggaccggctgtatcttcggcttcttctcccgtgaagtagtccgttacccagccctgctgtctgtcccaaacgaacaggccgctgaacgaaccggccagccagttcccctgcttatccttttgccagacattcagccccatgacactgaccgggggagcttcctccaccttcacgggaacggcatccggtgaagccagcgaataaaaaccttcggaagtggagagcagccagtcaccgcacatatcgtcatagcgcaccatgcgcagcttgtcgtgccaaggattagggctgtctaaggatgtgccgggcagagcgggtgtcttagtcagagccaacggtatcatgacgggtggacggagacaccagcccgtaacggccaccaagagggtcagtatgatagtggtgcgtcccagcttgtcgtgccacagcagggagaggcgtgtccatcgggcttcgccttccgtgtgccgcccgtggcggtggcggcggcgcatgtccttgggcagcagccagtaggcaagccccgtgaggcacaggagaaccagcacaacagccaccgcatccacaaccagcttgcctgccgtgccgaacaactccccgctatgcaacatccacaccgtgcggaaaagcgtcaccttcggctcgtaaccgtcgggaactttcacctgtattttccgaaatccggcgtgagaagacgtggagagatagaggtacgaacgtccggcaactaccagcgtgtcgccccggacggtgatgtccgaaagacgttctccctcgtccaaaggcagggggatttctatccaagccgttccgtcgtggcggtacaggccgaactggccggcggcatacagcgtaccgtcgggtgtttgcactatgcctttcatgctacggtagtccgccccttgggaaagtccttcgttgaagtccgcaaaagccgaggcggcagtgtccgtgcgccataccccggctgcaccataggccagtatatgagccacggaatccttgtccgtatagcgcagcgttcccctcagcagcccgccgttccatgcttcgaaacgataacccgcaggcagccacttccggctgacgttgatgtcggccaccgcttcacgatgattcagcacaataccgctccaacagaacatgagcatgaagaagcagaacagcaacccgaaccatttatgatgtttcctccaagttatccgtttcatgatttatcttttattgtcgttttacatccgcagttttctttcgtctgtcacaagcgagataaagcccggttactgcaaacgaaaccagaatcaacgcgatttcctgcacatgtccttgtggatttgcccatagcccgttcagcaggtgaatccggtcgaagacctctaccgcgatccagaagataattacggtggcgaaaccgaaacgcaggctcatgccccacgaagcataacgcaacagcttggcgaacatgaacagcgaaccgatgaagcccagcatcccgacaagcaatgtcaccggatgatggtcgccaaaaaaacgctcatcgtagcagaacatcagcaccaagtagcacgtccacagcatggtaatgacttccataaaagcgacaatgctggtatggcgtgtcatggggcgtgcggcgatttccttcttgtgcttgccgaagaacaagcgctgccaccagttcaggaaattgcagccgttggcagtgcagaacaggtacagcatcatcgtcatggcccagaacccgaatgtggacggaagtatcaggtattccggccggctgacaatctcgcccgttaccgggtcgagctgcgcctgcgtgccgaaacggttggcatagtacataaacaggaagtcgatggcgcccatccagtaaaacataccgccgaacaaacccaacagcgcttgtttgacgtcgccttttatgaatacaccgataatgaccatcagcaaaccgaacagccccattcccataccggcatagaactgttccacccccgccgtaccgtctttcagcgcacgtgccaggatgtgtgtcagcggcatggcaaccaatgtcacagcgatggagacaaacgctttaagccagtgcctttttctctcttttgttgctgccatatccggttttctttattgggaaacggcattctttttcttcgcacccatataccacaggtaaacagccagtacaaggaacgctgccagtatgataatcatttccgtcttatgccccatagggtctacccatatctcgctcaacaaatccatacggccaaggatctcaatcggtgtccagaacacgataacggtagcgattgccatacggatgttggccccccacgcagaaaggcgcaactgtttggcgaagataaagaacgagccgataaagcatccgacccccaccaacagtgtcaccggatgattctcgcccaggaatacatcatcgtagcagaacatcagcaacaggtaggaagtccacagcaacatcatcagttccatgaatgtgacgatactcgtgtggcgcgtcatggggcgggcggcgatgtcgttcttcttaccacggaagagcaaccgttgccaccagttgatgaagttgcatccgttctttgtactgaacaggtacattaccataatcatcatccaaaaaccgaacgaggcgggcagtatgagatattcgggacgggttacgatttcacccgtcacagggtcgagttccggctgcgtgccgaaacggttggcaaaatacatgaagagaaattccacccagcctgtccagaagagcagaccgccgaagaatccccagagtgtttggcgcgtatctcctttggcgaatacgccgacaatcaccatcgccatacctaccgcgcccatgacaaaggccgaatagtgcagaacggtctcgctcatcagatgctccatgataatcatcagcccgtgccccaaaggcatggtaaacaataccatgaggaaagaagcgatggctttccaccaatagcgccgtttggcggcaggaggtgttacatttgttgtttcagtggtcgttacgttagtcttttccatattccattaatttacgtttgatacgtttcttgtagaatactataataattgccgcagcaaccagcatggcggcgtgcagcgtaattgtaaactcccaagtgggagcattggggctgtccccgtacttgtctgccatgacgaagtgggcgaccgttatcgccgtcaggaagacgataactgtcggccatttcacccaccgccggttgcagaagcgcataaagcgcacgaattgtcccatcatactttccgtcatttcaattcgtcgcaatagtaactgattctcccgccttcatcaccgatttccacgttggcatcgtaccaactgataatctgtatcttgaagtacctctctccgtcggcggtacgcaccacatacgtgtggaacgaaggggtgtatgtggggggaggcccggagaagctcatggcctgcgacagcagcgggttggcattggtctcggtcgtggcaggaccgttgttggggtcgaaccacgggttggcatcgaagtccagattgttttccacaaggtaatggttccagtcgttctgcgacatggtgacgcgcacgtcgtccgtgtcaacgacccattccaagtcggaaggcagttgtgaaacgctcgtccagtcatcgtaaccgccatagcccaagtcggcggcaccgccctgaccgatgccgctcgtacccgaattggtacgcatggtatagccgcagaaagccagatcccagtccgtgcggttgatttgttcgccttccttgatgtccttgttcacggtgtaagtgttgaatgactctcccgtgcggaggttgaagtatatccagtcgttcgtcacccctgtggaatagcccgacttgcggggcagcgtcttgcccgtaaagggctgtatgtcgtcatagtccacgcaggagaacatcgtgagacagcccagcaggaggcttaccgttttgaataatcccatacgtttcattgtcgtatatttaatcatttctttttccttaaagagttaatcacatcgtccagcataaattccaactgcacccatccgcgtgttcccggcgtggcgggcacgttgaacatcgtgatgcccgaaccgagggttttcggcacgtagttgaagatgttgtccacaccgagcgtcagttttaccttattgtagaaggtctgcgacaccgacaggttgcacagcacgtattgcggcaggtcgcaacggaagtaggcgtcatagctcttgttgtcctcttccacgaacacgcggtcctgcacgtcgaacttcttgcgtcccatgtacgaggcgctgaacacggcgttcaaccggtagttcttcttcgtgaacttgtagtccagactggccgtggcggcatggggagaggtggtgttcacctgtatgccctcgttcttgctcacgttcacgaagctgtacgtcccgttcagcgtcaggcagtccagcacgtgccagcgcagcaaggcttccagccccagaaggcgttgcttgctcaaattggtgtactcgaagttgtactgcatgtcgtagatgcgccatacgccctcgattttatcacggaaatagttgccgtaggccgtaccggacaggaacaggcggtcgttgctgtactcggctcccagcgagaaataattgttcttttccggttgcatgttctcgtttccgcggatcatgaacatgcccaaatggtcccagttgaagaagagttccttgatactcggagaacggtatcccatcgaatagttggcgcggatgctccaccgttcgttgggcgaatacttggcggcaatcttgggcatccccatgaaaccgaacgccttcgagaagttggtacgcagtccggcagataccatccacttggggttgatggtccactcgtcctgcaagaaatactccgtttctttcaaggcgcgggttttcagatcgtggttggcattgccggagaaacggtcggaggtcagttcgtccgacgtatgttccacaccgaagatcaggctgtgcccgtcgaagtagttgctcgtgatggtcaggcgcggctgccagatgctactctcgtagtccttgttgcgcgtgtcgatgcgctcgtgccgcttgaagcggtcgtaaaagtcggcatgaaggctacccgtaacgctgaaccagtccttcacgtggtaggtcagcttggctcccgccgtccagtcacgcgcctggctgaaagtcatgtcctgtatcaggtcatacgtgttcatgaagaaggtgctcccgtaaaccaagaccgagaggtcatcggtcgggtcgtaatacagtttttgggaaaccgtgatatgctccttgccctcgatgcccatcggcggacgtgaggacgagttgaccacggtgatgtcgtgcggaaggaagggattggcctcttgcgtgtagaccttcttgtcattctccgcctgatacatgtagaacgcatccgaggaactgtaccatgcgtcggtctgcgaggttactttccccgccttgaatccggcagatacccagccttgcaggttggggcggtcggcattcttctcgaacatatacaaaaaatccttcggttgcggattcttgtaattgcgctcgttcatctgtccgtagcgcacacctgcgtcgatggaaagcggtttggtcgttttcttcgtgataaggttgattaccgcaccggcggcacgcgagccgtacagcgtactgctggctccttttacaatctcgatacggtcgatggcgtgcaggttgaaacgctcgtagtcgagattcccggccatgtcgcccgtcatgcgctcgccgtccatcaggaacagcacgtggcgggcgtcgagcccctgcatggagatttcgtttccgaagcccaccttctggatattcagaccgggagtttcctgctgcaatgcctgttgcaggttgctgtatccggcttcgaccaactgcttgccgcccaagacttgcgtcgtaacgggcgacatcttgatgggtcgcgctgtacgcgaaccggtgacgactacctcgttcagtcccaaatgatcctcttccagatagacggtcttctcggtttcggtcgcttctatctttcctgttgccggaacaaaaccgacataggatattttgtaataatacgttttcttggaggggattttcagttccgccagcccgtccacattcgtgacgctcccctgcaggttttgcaacgcttcgttatcggcatagaccacagtggccgcgatgaccggctgttccgtccctttctccagaactttgagctttactttacgttgtgcctgggcattcatacatgccagtaagacacaaaataagatggctgttattcttttcatctgtctatcatcaaaacatgttattctacacaaaaaagagggaaagccgtgtgtcttacggtctttccttctttcctgcaatcgaaaggtcaagccttgccctgttctttcttggcttcttccaagtctttttcgtactgggcaaattcttcttcaaagcggtcgatacggctcttgtcgatttcttgcaggaaggtttcggtgcgcacgttcatcatgttgtagtccacgatgaactccacttgcttggtgtccacgttcaggaaaccatctacacgggcgccgctcccttcctggttgtccgcagcgtcatcgccgctcgtggtgacatttccgtccgttcccacgaacttcacccaaccgctgccggggtattcatccttttcccaactgttgagttgcataaacttcgttgcacagcggaaggtgatggcgaagggcatggcgcccacggtgaagtcgctcaggtcgagcaccatcgtgccgtcttcccgccaagaaaagttgaatttggtggggcaaccgctttccaacagcgtcttgtccacaccgctcattgtagcacgggttgagagcacgaggtctcctacaaggatttccttcgccttatcaatatattcctgtgcaggtggctcattggtaagtgaatcgtcactttcacacgaacttaatccgattactgttgccataagaaggctgaataaaaagtataactttttcattttgcttatataatttacttgttttgtaatccataattgtttcctgttcattacccttgcctgcgtgtattccgcaaagggtatgtaaagtcatggtttttacatgattaaaggcaggctttttccgatggcaaagtctgtctttgatgtgtaccgcatgtaggcttcagaagcggttcaggcggtttggataattttgtttcctcgccgtcggttgcataccggaagtgtttttagcggcatagcagccttgctgacaggataatggtgtcttccccattgggtgaggtgaatatattgtgataattttttcttagtaacacacaaaaaaagagctaagagaaagccgtttgacagctttctccttactctttctgaatttaatttcgttgcttgacaaaataatgacgaattattttgttccaacaaagtgtacggatgcagggaaatctgcacctaagaacttaccggatactgccagagtaaactcgatagtgttgcctgtaactttggcatcagtcaaagaatctaacttcaatgttactaaatccatgcctaaaatggtcaaagttcctgctttatcacctttgaaagctgtaatttcaccggtttcttcatctacttctacttccaactcgatagtgatattccccggcatacttccgatctgcggaaaatcgcaactcaaaataccattttcaagagtataagatgcagcacgtggctcataatcttctcctctcattttgatttgatccattgtaccgttataagtaccttcgtaatcgctgattgccaatacggtacttacaccatctacatccatcactgtggcagcgtcagcagactgtgccattccgaaacttgctgcaacaagggcagctcctaagaaaaattttcgcatcgtttttataattaaagtttaataaaaaaataattacactttatttttgtttgttcaataaagtcctccaacggcatcctttgtttttatcatacgataaagaagaagtataacctaaccttctgaccgtatcgtctgggtcaatgtctgtataatttgctttcaggaatgcttgggttgattctctatagaaagtgttctctgaacaagcgaaataagtaccggcatatccatcttcactatagaaaatggtcagttccggataaaccagattaaagtctttattcaaatcacctatactgagttctgctaccatcttgacattcgacatgtcaaatgtttccaatgcgtccaagcattcaatatcaattctgtaggctttcaattcatttttttcgggcaatttgatttctttcagtataggacatcccagaaccatcagactactgccatacgtaccattgccttccgtttctttatctccttgaccccaaatagtggaataactcaaatctaacttctgcaatgccgggttattttggacccaagcacttcgcaaatctgtagcattggataagtcgatatcttccacttctatattttgcaggatgacttgggttatgaatttccctacttttatattgggcatagaagctatactttcttctccggcagaataaaggctgattttagcaccttcccaataaggattctccaccagaaactgaataccctcaaagttggtaacattatcagcaggagcaacaagcagttcctttgttttctggtcgagtcccaaatgtttgctaaggtctatttggtcgccgttaaacagatcggcaaaatttgtctgcaaataagtgagcaggtttgcgtcgggcacgtcgcgcagggtggtataagtttgcagattgccgtcgacatcagtcatcttcatatcaatggtgccggcggtgatggcttccttgttttggcggtagaaacgcacgagatcttcgatattctctttagcggtttccggaaggtaaagtttggtaatttcgtgcaggttagtcacagtttcatcaccgttttcttccactacgacactcacaagattatcatagtcgtagatttcattacccgtcaggtctattccggtgatttgttccggcaatttggcaaagtcgaacgccgggccgtaaccattgtccgacagatccacatcagtcaagttagggaacatggaaagttctgccagtgcgtctgtggaaatctgcgttccggagaggtcaagcgtcgtcgtattgttagccaaatcatcaagcaacagattgccgtcctcgttgaatgtgtagcctctttgaacaagaatggttttcaattcggtattctgcacggcacccgtgctgtatgagagggtgttgtcgtcatcgctgcacgatgcccctatcagcagcattgcgaatgccatcaaaccgacatgcaaattgtttcttttcatctttctgtgattttattatttcgttattattatttcggggtgcaaaattataacgagtttactcagagcacaatacctaaaaattggtatataattagaagcaaatcaccactcattaactaaaaaaatataaacttcgctcctgctttataattgtttgttaaaacggtacttgaaggagagcatgaaccaactacctatctgctgcgtgtgtctctccgacaatccggaggaagagacgctgcgggtaaagttctttttctggctaaggatgtccgcccagtagaatgacagttccgccttcttctgtttgaggaaacgccaagaaagggaggcgttccacactacctggtcatcttcgccgggggtgatgttcgtcccgttgcggaaagaataatcgacatcgctccgcaactgaatgccgccgggcaggtcggcgtaggcgttcacccccaagcggtagtcgcgggtgtaatcgccggtttcgcgcaaaaggttggtggagtggcggaaacgccagtcacccgtcaggtcgaaacctccccattggggctggtagccaaaacgcaggttggcattcagtgtcgtgttgtgggtcgtactgcgctccggcatctcctgctgtccctcgttgataaggcttacgttctggctgaacgaagcgccggtacgtgcggtaacggaaaatcggcgtttgatgcgcttctggtatcgcacggtggctcttgcgttccaattcccgttcacattcacgggatagctttctataccgcctgtttgggtattgtacgtcacagcccgtgtcacactgttcaccgtgttcgcccaagtcatgtctccgttcaaacctatcttcgtgtctcgtgcttctaagcgcaccctttggttgtacgaagggcgcaggctgggatttccccgtgtaatgttcagcggatcgctgttgtcggtcagtgtcagcagttcggtcagtcccggctgtttcgtgtctccctcgtaacttagttgcacccgtgttttctttttgtgccacaagacggtaacagccgggtagtagttcacggaggttctcagcgtgtcggcttgcatccgcccggtcttctggtcgagactctgccgttcgggaacgacggacaggccagcgttgatttcccaagttctgtccgtatagttaaggtggagggccacttcatgcgctgtcgtgtggcttcggcttctgttgctcaggctgtcggtataggctgcctcgtagccttccggcagggtgtacaagggttcatcgtccgtaccgtcgaaaaagcgggacaggtcgtaggtattgcggtcgttgttttggttttcccgtctgaatttatacgaaagttgtgcccgcaggctcttgtgtagtggctgtgtcagtatcagtcccaagctgaatttgcggtttctgtttgggctgtcataatattgattacggtagaggacggaatcgttaccccactcatcctgcaattggtaataggtggtggaggacacggaaaacgcctcgttctttcctctcccctccgagtattgcatggttagccccaaactgctgcctttctcgttcagccgtcgggtgaggtcggcgttcaggaaatactgccggttggcgcttgttgaacgggagttcatgcggatgccattcacccggatatcgttttccgtttggccgttttcttccccattgaacggtgctgtgatatccaattctggattttcattgtaggtcgcctgccggctgtcactcccgtttgtccctttcatcgcactaaagctgcctgaaaggttcagcaaggtcatcttatcgatattccatttcatgcttagcatggtgcttgccatgcggttggtgttgtggcggtcgctggtcgcatagcggtagcggttccccgttttcaggtattgctcgtagtaagatgtcccctcgttcccattgatagcattgctgtacatgacattcccgttaaggtgtatcttctttccgaactttttcaggaagttcaccgctacattgtcttggcggttgtctttgtttgcggatgtcatgttgcggttgccgcttttggcgattaccgacaggttttccccgccggttttgaagaaattgctgattagttccgcttcttttttcttgttgttacccttgcctgcggctacggaagtcatcagtgtaccgttgaactccttcttggtttgcaggtcgagcacatagttttcttcccctgtttttatccccatgaatttctccatttcgctacgcttgtcatacacttttatcctgcttaccaaatcggcgggcagattttccaaagccagcgcatggtttcctgcaaagaacgcttccccgttaacattgatttccgcaatgggaagcccattataaaccaaggttttgttttgcctgtcatattccaagcccggtatcttttttaccagctcttccaagttcgagccttcgggaatccggtaggcatcggcattgatgacggtagtgtcgcccaccagttccacctcctttatgggagccgtgaccaccacttcggacagttcaagaccttctgtcaagacaatgtttccgacatggattttcgtcttgcctgtatttaatgcacgaaactccggcttcatacctatataagaaactttcagcaggtaaggcgattctttctttgcatggaagctaagacggaaattcccgccggcatcactcatcaccccttttacaagggtggaatccccggcttcgagtaccaagatattggtatagggcaacacctcttgtccttctccattgttggaaacgacaagggtctttccggtcacatccaccctctgttgggcaaatagagttatcggaaacaggaacataagtatcagtccgagaacagatatacgcacaattacccgttatttttttatagtttttaaaagaaatgaaaaacgggtacaaaattacaagcttttaccagccgtgccaataccaaacaatcggtatatataataactcattactttaaccttcaacatataaaaaatggtcggaacgatacagagtacaagaaaacctgccgtacaaccgggtcttttccagagcatggcgtcatgtatgaaccggacatttgtcgtgcaaatgaaagccttccaaagaaacaaaccccagtccacaataaaaacaaatccggcaaccgttcttttatagaaccggctgccggacgagccaaattgcggaaactgttaccgtttcccttccagaatcagaatcggccgacccgcaaagcattcacgaaagcgctggcctcttctcccgtataatggagtacggaagatgccggttcgtaagcgtaaggaacatacttcagcaactggacggcagcgaagttaccgtcctgcgaaaccatgtagtccatccgcacaccgccgtccttcttcggcagtacctctgccttgccgtcaaaagtcttctcctccagcaaccgccccaatacagagaggtcgcccgcatcgaagaaacaagaaccttttttcaccaaactgccggtcggaacgtatatcagactcctttttcttatcatcaggcgaatacctccggccaccagaaaggcgattccgccgaccagcaggacaggacctgacgcggaagaggaatcttccactttcgacgagaaaaacagaaggcacagtcccaccgcacaaaaaaggagggaaagaataagagccgaaatattggtaatcttctttatatcgggatgcgctgcggaaaacagggtttcggcagcagaaatgttttgattcatacggattgaaaattttatttttgctgattgttcaataataagatatactcacgacgaacagccacaccccgcttttcagccaagtgtaaccgtcagtataaacgataaaaaaacaaaccgctaaatcagaatccgtctcatcccgaagatataatgctcgcaggcattatcccagttcgggctacgggaagagtcatgcacgagggtacaacaataggtcaggttgttcatgcggcaaatgagataccgctgtaaaattcggagaaaatgggccgtttccacagatatgtaccgaagatgcatcccctttaccgatgcgccggcacggcaagccacatcggggatttccccgattatgcctgttatgtcgctgtcctttttttgccggatagagtctctgtcatggaattgctgaaaagaggcgttgtccgtatttcggacacaacattcctgcgcagccgccacaccggccgccggaacatgcagcgccccggaattgcataccaaggccagcagcaccaacgatagaacagcaacgaatcctttcataccttaattttgccttgcaaaggtaagcataaaggcatttttttaccattcccgtgaaatgattaacaaaaataaacggaatcatctgtgttttccacccgcaggacttaatgcgggggcctctctggattcggccagtgccgccacgcactcttcgcgtatggacttgatgtaatccagtaccattaacggatcgacactttttccatcgagcttgcaggaaatatgcaggtgttcgccggtgctgcgtcctgtagaaccggtaataccgacgacatccctcggcccgatagcagcccctttccgggtaaggatacgcgacaggtggcaatagctgaccgtgtagtctccatgccgtaaggtcacatacttgccggaggatttgtcctgcccgactttcactaccactcccgccatcatggccatcacctcgtcgccccgtgcgtggaggtcgattccgttgtgaaacttcttttttccggtaaaaggatctttccgatacccataaagcgagttgattttcatccggtgcagcggatagcttacgctaaggtaacgctctatccatacgtgtttgcaggtgtcggcgggcaatgccggggcggcgtctcctgccgacggtaaggagtcttggacggaaagcatgtttccgggcaaggtcgccacattatccctaccggcagaaacgacttcaaccctgtatcgggacggcacggtcgagaccgtattgaattgtgcttgaacggggcctgcgatacttgcagcacccgccatcaaaaccagtagtttctttctcatgcggcaaatataaccagccctgcccaagatgtcccgtttccacggcctttttcgaccaaagtacaacaaaaaaagcattcagagtatgaatttatgcgcaaaatcatactctgaacataaaaataaactctcttaatacactaatattattctattatatacaagggaatgaaaagaatctatctttgcaaagtgtaattcaaaatacaaaattaaatatgaatgtagtacgatttgaactaattgaattgccctatccgacactggcccgattcgggcttacacaggagatgatcgaggacttgccgatgcgtgtcctcgatgagatttgcgacggcagacactctcccgtgcttccggtccgtgtccgtgacgagaagggagaactaatcgaaagccgcagccgcttcgcccttgtccgtagagatgacggtctgtcggacgtggtattttatcccgtcctggaatcctcgccactggaacgctacgacgaggcgcaacagaaacaactgctcgcaggcaaggcgattcttgccgatgtggagacggcagacggacggcacagcaaggcattcgtgcagatagacgaggaaacgaagcaggtgatgtatatccccacgccgattatcgggcgcaacctgcaagtgctggccgacataatgcacctcggtacaatggaggtaaacagtatgcagaacggcgaaccgctgacactggtcgtggacgatgaacccgtcacggtgggcatcgacctgcatgacaagaccggcatccgcttctgttcgggcgacagccagaaatggaaagaacagcccaaacgcgagtgggacaagtacactttcggcgtgtacggctgctgggtgatggacgatgacggcaacctcgactatgttcccgaagaggaatataccgaagaactgtggaacgaacagaagaaaagcgccgagcgtaaccgtgcggcgggagttcacaaataatatcttaacatccagcgaatatggcagaacaccaatattattccgaagaggtacttatcgagaagatggagcgcggcgaatacggctggctcgactatgtgaatcatttctcgcccgaatggcaggaggaatatgcccgctattgcaaggagcacagccttatggcgggcaacgaatccgccgccgagttcgtccactacaaggacgagcaactggaggcggcgatggagaacggagatgcataacggaaaccctttttaacaacggattatggcgatacgaaagaataccaacccccgaatgatggacctgcaacccgaaatgcaggacatattgaggcgtaacggtatgcaggcccacgtggtcagcgacggcacgggctaccggctcgtggtgcagggccacgattcgccgctgctgacctacgaccttaccgagcgtcagatgttggccctgacggactggggaacaaactcggccaacaagaaagcctacaacgtgttcacgagcattgtagggaaagacttttatatgcccaagaacttcgtccatgcccgcaatgccaacggccgtgtcgctatggggctgcacggctaccgtatcggtatcggcgaatacgggcatgtgggacggttgggtatgccgcccccgtttctcggctggacgccacgccaccagtggggcttccatctgcggcgggtcggcggccaactgttctatccgggaccgcccattgtccctgaacggtgggacggacgcatgaagccgggcgaattgcagtcgggcggctacggcttctattacaaatacaaggccggacaaccggtgcaaccggcacaacaggccgacgtcctgcaaaacctgcagacggtcatcacgccgctggtcagccgtccgcgcagcacggaaccggcccgtacctacaaggaactgataagctctcctgtctatttttccaacgagaaatggcaggaatgtcttgcctcccacggccttatcgtcgataaggaggcacggacactgaccgtacagtccgaaaaggtgaccgccgatctggtctatgacctgacggaagaagaaacggccgtcctgacctccaactccatcgaggaacaaccggtcgagaagcggctggaagtcctgaacggggttatcggggcggattttgccgacaaggtaacgatggcggacctcgacagcaaacaacgtatcgcccttggtctgcaccccgaagtacaggaggaactgacgcagcgtcagcaacaggagcaggaaatcctctccccactggaaaaccagctccggcaggagatgccgtatggtgcggctgcttccgtcgatggacgggatatttccgtccttgacgagcgcaagggctggtaccgagaagaacggcacggcagggaggtcgaggtcggcgagatagccgtacacccgtcccccatagagggcaagtacaagatgacggccgtcatcgacgggcaggtcatcagccacgagatcagccagaaggattacgacaaattccttgcggtcgatgactaccaccgcatgaaaatcttttcgaaaatattcagcgaggtggacatgaagatgcggccggaagcacagcgcagtctcggcgtgaagattttcgccgcccttgcggcaggaacggtcgtcacggcgggtgtcgtccacggcctgcggcatcatcatcacggtccggagttctacggtgagcgtttcggaggcgagccgcgtccgtatttcaagcccggtgtcgatacgccgagggacgtggctatacgcaatttcgaggcacagatgaatcaggatattaacgatatgagaagagggagataaagacaattatgagagaaggagaccttacctacgacgacttcctgcaaaggctgaacattcaggacgtgctgattgacgcgggctaccacctgaaccggcgcgacggcctgcgctatccctcgtatgtccgtctggacagcgagggacggcgtatccgtggcgacaagttcatcgtgacgcaacagggaaagtgctgcttccaagcacagcagcagaaagtctataacatcatctcgttcatcaaggcgcacccgcagtttttcgctgaataccgtgcgggcatgtctcccgaccgactggtgaacctcgtgtgcaaccggctgctgaaccatcccatcgaggaccggacaacgcggattatacagcccaagcgggacatccgcccgttcgacatcgcgaactacgacctgtacaagttcaacccgcaggaccgggagacacagaagaagttctatccttatttcaagagccggggtatcgacctctacacccagtacgccttccaccgccacttctgtctggcgacgaaacaccgtgaggacggtgcggcatacaccaatctcgcttttccgctgaccttgcccaaaggcgacggcacggtcgtgggcttcgaggaacggggacgtgcaagaatggacggaagcggcagctacaaaggcaaggccgagggcagcaattcgagcgaggggctgtggattgccagccctgcccaaaccccacttgcggaagctaagcgtatctattggttcgagagtgcctacgacgcgatggcttattaccagcttaaccagaaatgggacaaggaactgcgaaagggagtgttcgtttctaccggcggggcaccgagccaacagcagttcaaagccatgataaaggccactccacgcgcttaccaccatctctgcttcgaccaggaccgtgccggacagatcttcgccatcaacttcgcgctcacccaggcgggcaagacattcaccagcaacgtgacgaaagacgacaaactgctggtccgtatcagtggcgaggagaaccagaactacgaaataaaactcgaacccttcgactttcacaggataatcggcacgcttttacgtcccaaagaaatctatcgggaagatggtacgctcgactatcggacaatcggcgacggatatttgcaggagatgagcatggtgtgccaagacgagtacgagatagcccttgccgagggttcggccagtgaggaaacactggagggcatgagacaaaatatcatggccatagaggatgcgatccgtaatcttcccgctcccggcgaggacagcaccgaccttattgtgtacgagcccgctgaaaaaggctataaggactggaacgaacagctcttggcaaagatcaggctgcaagaatcagttcacgaagagccggccagaagagaagaacccgaacaggaacggcaagcacgtttccaccgatgacaacgcagtaccccctacatgaaacaacaaaagaaaagagaagacaatgaatgacaagaaattgacacataatgattttttgcaaagactcgatatccgggatgtactgcttgatgccgggtatcgccagaaccgacgcttcggactacgcctctcctcgtttatccgcacggacagtgaggaaaagcgtatccggggtgacaagttcgtcataacgcaacagggaaaatgctgttgccaaccaccccggcagaaggaatacaacgtcgtttcgttcatcaaggagcacccggcgttattcgcggaatattatgagggaatagacctgaaccggctggtaaacctcgtgtgcagccgcctgctgaacatccccttcgaagaatacgaggtgcaaaccgtaccggtcaagcaagacctacgaccattcgatataacagactacgacctgcacagattcaaccctcaagaccatgagatgcaggagatattctatccctatttcaagaaccggggtatcgacctcagcacgcagaatgctttccaccgtcatttctgcctggcaacaaaacacggcgcagacggtgcggcatacacctgtctcgcttttccactgaccttgcccaaagagggcggtacggtcgtgggtttcgaggaacgggaacgtatgagaatggacggatgcgatagctataaaggcaagagcgaggaaagcaatgagagcgaagggttgtggattgcaagtcctgccggaacacctcttgccgaggccaaacatatctactggttcgggagtacctatgacgcgatggcctattaccaactccatcaggcgaagaacaaggatttgagaaaggcggtctttatctcaacgggcggcaagcctatcgggaaacagatgagagagatacttgatcttaccatccctgcccggcaacatatctgtttcgataatacccggaaagggtcgaatctcacatgggatttgcaaaaggagatatgccgctcagtacgttttgccatagaggaaacgccggagaggaaaccctatctcgattccataccggacggcggggatttgacagacggagaattttacctattgcccaagggtggtttgcaagaaatctgcatacggttcgacgccgaatcggaagaagcggagtcgatgcgttcgagcgggttgtgtgccccggaagacgtgcaggaccagatagataccacgaacaagtgctaccgggaatatcgagagaaactacgggagttccttggtattgacagggagcatgatgtctccattacctgggaaagtccggattatcgccatacgagctggaacgaacagcttttggctgaacagaaacgtgaagagactgtcgggcaggagtcggaaaaagaagaaaacgccgggcaggaacgacagatacactttcgccgatgaccatgccatataccatacaagatgtccggaacattatcctgcgcccgcacgccgggcaattcgtcatcgacgaactgccattgatattcatgtgcatggcgggactggtgtacggcggcatggaaggtatgccgcttggcggtatggcgacggtcattgccttgtttctgttcctcgtgctgctgtatcgtttcatttgcctgcgccggatatgttaccgggtcggcaacgaacagcttgtctgcgagcggggacttttctgccgcagggtggactacatggaactgtaccgtatcgtggactttcaggaacaccagagcctcctgcaacagctttgcggtctgaaaacggtcgttatcctttcgacggaccggaacagcccgaagctcgaccttatcggtatccggcgcggaaacgacatcgtggcgattatccgtgaacgtgtggaaatcaataaacgaaaaaagggaatctatgagattacgaatcattagcatatgggtggtctttgtgcttgccggtctgcttccgcaattggccaaggcgcaggttgccgcttcgaacccgttggaatgggcagccttggccgagggaaacgaactgataaacggccagatagacaaacaaatcaaggggcagacacagaccgccctgatgcagaacagtatcgcagcggagttcaaccgcatacatgagtgggaaaagcagtacaacagttacctcaagacggcgaacggttatgcttcgtcgctgaaagcctgtacccacctctataacgacggcgtgcggattttcctcacgctgggaaaactgggcaaagccatcggggacaacccgcagggcatcgtcgccagcatgaacatgaacaacctctatatcgagacggcgacggagctggtttccgtgttcacgttgctgaacgacgccgtggccaaaggcggcacggaaaacatgctcacgggggcggaacggagcaaaaccctgtgggctttgaacgaccagctcgcggcattcagccggaaactgcatctgctctatttgagcctgcgctattataccctgaacgacgtgtggaacaacataacggcgggtatgatagaccgcagcaacggcgaggtggcccgtctggccatgtcccgctggcgcagggcggcagccatcgcccgttgaaaaaaggataataaaaaacgaagaacgatgaagcggataatctcgatatggattctgttgctgtgcgccggtatctcgaaggtacaggcgcagaacgatgcgacccttgcgggaatgattctggtttataccaacaaggccgagaaggaactgaaaaaccaagagaaggtcatgctgatgcaaactacagggcatgtgtggacgaaggaagaagtggaaggcacgacggacttgcaacgggagttcaacaattacctgaactcgttccgctcgattgtctgctatgcggctcagatttacggtttttaccatgaaatatcgcagcttacagacaacatgggcgacttcaccaaacaattgagcagacattcgacgggtgcattggccgtcgccctctccacgcggcgcaaccagatttaccgggagatgatattgaacagcgtggaaatcgtgaacgatatacgcacggcctgcctctcggacaacaagatgacggaaagggaacgtatggagatcgtgttcggcatacgtccgaaactccggtcgatgaaccggacgctgcagcgactgaccaaggcagtgaaatacaccacgatgggcgacatctggcgggaaatcgacgagggcgcacgccctgtcgcggacaagtacgacatcgtgaaagccgcccaaagacgctggcggcaaattggaagaaatgtaagaccctaaaaaaaagaataaaaatatgggagcttgggatacgatattgaaatacggcggaaaggccatgaaaggcatgggcaaggccgccaatgcgacggggaaaagtgccggtcatgcggtactgcatccctcgcagacccttcggggagccgggcaggcggtcaaaacggctaccgccggagctgccgtcggttatgtgggttgggaaaaactgaccaccgacaaaagtgtcgcacggatcgtcagtgaggccgtagtcggcaaatccgccacggatgcccttgcaggtacgaccgaagacatgaaggaactgaaagacaaagccggagagacggtctctgccataggtgaggctgtgggaggcgcggactcgaaactgaacggggtatcgaacttcctgcgggaagcctccggcggtgggttgttcaacatgctcagcggctttttgcgaaacctcggagggggcaatgtgtcgggattgaacattgcaggacttatcgcagcagcgtacctcgtgttcggacgtttcggctggctgggtaaaatcgccggtctgtttctgggcatgatgcttatcggcaacaatgcgggcgttgtccgcacggttccctcggaaacggtatcgaggacacagacgccgacactctctccggaggaacaaacgcaaagcggaggaatgagaagatagaaacacgaaaatatatatcacaatgaaatatacggaagaaatgattctgcactccgacagcggctattgtatgccgttcgaggagccgcaggggaaagatgtggagatgtcgctcggctacggcgaacaggtacacccggcaacgggagaaaagttctttcatcacggaatagacttcaacgtgaggtgttacatgctgtcagccgtggccagcggcatcgtgtcaggtgtgggcaacgacccggtacatggcatttgccagacggtccgttacggcgggtacgaggtgacatacggtcatctgtcgaatgtattcgcccaattcggacagcgggtgaaagccggacaaacggtggctttgagcggcgaactgctgcatatagaagtcaaattcaagggcgaggaactgaacccaatagagttcctgaccatgttgtacggcaacatcaaggctttgcaggaagccgacggcaatggtgcggcgtctttttacgatgcggaaacaagagtaaaaaacgactacgagaaggatcaaagggaaatagaagagctgatgctccgctttctgccactttacatggaggatttacagcggggagcgtacacggtgcccgcacatacggagcagtcgctgcgccacatctttacaatgggagctgcgaaggagtatttctatgagaagatgccgagcatgtacaacccgctgggactggggcgcaaagccatgccgctggcctgcaaggtacagaacctgctgatagcggatttcctgaactaccttgccctgcggcatgatgtgtacctttccgcaacaggcggcgaggtaaaaaaaaacttcatgacgaagccgtagcgggcagcggactcattgatccgttggcggaactggacatcgacatccagagcttcgacataccgagaatcgtctccgtctatcccgaccgtgccggagtccgctggtggacgaaggcatggttcaacaaccgggaggaaggggaagcctcggtagaaatcgagcgggaacaggcgatacgtttcattcacgacaatatcgaaaaggacacgtggctcgaagagtttttccccaagcaaatggaggtgtaccataacgctatcgagcagacgaaggaacaactgttgaaacaaataaacatgatatagaaagacattgattatatggacggaatcaaacatagcagaaggtttgcggagttggaggccctgatgagcagttatttccgccatcatcttgtccccgtcatgacgcagacgcaatcctacctgaccgaaaaacagggcgaggaaatgaaagcgtattcgacctccctgggcggcatactcggcatgatggcgtcagcggggcaaccgctcgccgacccgtaccagactctcaaggttacgggagagtggaactccaagacgaccgaggactacatcgggatgtgcaaggacaggattctctcgtcggaggagatgcagcacgacctcgcctacatggccggacagtggcgcgatgtcgttgtgaaggaagtcggacgcgagcgttacgataaactgtcgcaggaattgggctgcgacctcgcctatgccttcgtggactatcgtgtagagcaactgatgatagaccaactggtcaaggaacgtatgcccaaatcctcggcggactacatcatccgtaaggcggcagaatcgagcctgctgggattgccacaggctttggggcgctcgccgctggccgaagagatagaaaaacgcggagaggttgcctaccggccgagcaagttggagaaaggtgcgggctgggtgttgggggcttcggccgatacggtcatgttgggcggtacgggttcgtggacggccgttgcacggttcatcggtgcggatacggcaatctcagccgttgccgaccatttcgggaaggaggaaacgcagccgctctctgcagaggagtgtatcagcaagggcgtgttcggcagcgacagcaacgtgttcgacagcttccgcaaagaggcggcaagcataccgggcaaagaaaacacggctcttgccgcagccaacggaaagttgcaaaagaagataccgattgtaacattcgattttatggactggtggaaaacagacaatagaaatatgccgtggcgggaagaaaccgccgaggaggaacggaaacgggtggaacggtataaagacgtgccgatggttgtcgctcccggacaagaggaagcctacctgcaagatatggaaagacggaaagccgaaacggaggaacagacggaatcgaaacccaaacaaagggaaaaagaggaaaaggaagtgtcgacttccgccgtctctgcgggggaagggatgcggcaggaacaggcaggtcagggaacacagaccatacagaccaacgagaacggctgggacgagctggtccgctcgctcggactggacggcataggcgatgtcgcgggtaatctgggctatatactggccatgctgcccgacatcctgctgggcgtgtttacaggtaggacacaatcgctgggcctgaaagacaacctgctgccgatagcgagtatagtggcaggtatgttcgtcaagaatccgatgttgaagatgctgcttatcggcttgggtggcgcgaacctgctgaacaaggcgggacacgaggtgctgggaaaagaacggacggagggaaacagaaatgcagccacgaccggtagagaggtacagtacagacgctatcccgacgagccgctgaatccgcgtatcgtgaacccggcactacaaggctgcacgctggttgccacgatagaccgtgtgccctgtacggtgcagctcacccccgctatggccgacgcttaccgtgcaggagccttgccgctgaacacgctggccaatgccgtgctcgcccaaagcgacaagctccgccagatggcttcgcagaactatgacaacggacagcaggaaaccatcgtgcggacacggggcattcaataatcctgtaaccgataaaaatatgggaatatgaaagaaaaatcgcaaatagaaaagaatgccgaggagcgtcagatagagctgctctccacggctttgaacgaagcgtcgaatgccgggggacactggctcaacgctacgggcaagggctttccgaaattttatccgaaaggtgttgccgtcagcccgttcaacggcctgttcatggccttgcattcggaccggaacgggtgcaagaccaacctgttcaccctttacagcgatgccaaggcacgcggcacatcggtacgcgagcacgagcaaggcgttccgttcctgttctacaactggaacaagtacgtccaccgcaacaatccggaggacatcatcagccgggacgcttatctgaaactggacgaggaggtgcagaaacagtacaagggcatacataacagggagatccgcacacttttcaacatcgaccagacgacactgccctacgtggataaggagacttacgatgcggtattgcagaaagacggtagtgccgtggagcgtggctactccgaaaccgatgaacggagactgcatatccgcttcaacgacttcctgctgaaaatgcgggacaatctcgtgcccgtgcgttcggacggcagcggaatgccccattacgagacggaccgcgatgcggtctatatgccgcgccaacggaacttcgagcattataacgactacgttcaggaagccttgcggcaaatcgtgagcgccacggggcaccaacaacggctggcccgtgaaggcatggtgatgaaaaacggcatgggtccttcggaagatgccctcaaacaggaacggctgatcgtggaggtggcttcgggcatcaaaatgctggaactgggactgcctgcccgtctgtccgacaaaagccttgaattggtagactactggaaccgggaacttaaagagaaccccaacctgatggatgccctcgaaagcgacgtgaacaacgccctcgaagtaatccacaaggcggaacggggcgagaaaatcgaatatgccacgatgcgtaaccgccggcagacttcggatatgcaggagcagttacccaagcatttctacgtggccgatgaaatccggaaacacccgaacaaggaggacaagaccattgtcatcgtcatcgatccgtcctcgaaatcggcggatgtgatactccctgccggtgcgtcgccggaggtggacaacgaagtgccgggcatgaacaaggcccgtatcggcagggctttgcgaagggaaggtattgaaaacgtgcgtttcttcaatcccgacggcgcatgggggtacaggcccgatgatgcctatttcgccaagaaacaggtatcactggcccgactgaagaactgggcactggagatgctttccacactggacgtgacgcctgcggtcaaacgggcggacgaaatcggtttcgaccagatacagatgatccaggacgacaagaaccgctgggcgctgtatctgaagcccgaacatcagaacgggtacagtatctatccagacaaggaggacgtgaaccgttttttctccacgctcaaacaggcgatggacaacatcgacaaggtacgcatggaactggcgcacaagtattatgtactggcggaaacacagccagacctgaaagtggacctgttcagcagcggggcgcaggacatcgacctgaaccggattcagcgtgtgtccgtattcaagaccaaacaagaaggaactctgtgcgtggcgaccatcgacgggaagaaactgcagccccggagcgtcacgcggcaacagtggcagcgcatgtggctggccgaggaccgtgcagaatataaacgccatctggcggccacgctttttgccgatgtgctgcgtaaaggacagacgcaggaagagactgccggaaagaaacaaggagaagaggataccctacagcaggataaggacaagcaccccaagcaagccaatgaggaatcccccaaaactgcttcatccttgaaagagttgcccataaaagatataccggaacaactgtatgacaaatacaagaaaatcaaagaggaacaaccggaagcggtcgtccttttcaaacatgagaacaagtattacgcttccatgtatgatgcggagaccatagcgaacgagctggacatgcctccggccaaagaacgcattccgtatgatgcggacaaaatcatattggtatttgaacacagcaatgaggaaacaaggcagcaaatccatgcgctgcgggcatacgtgatggattgtgacggtatgtccaaggcgcagcaaaacgagcctgcagaggcaactgacgaacagaacgagaacgaacaacgtccaaccatgaggaggtaaagatatggcaaacaagaatcaagaatatacggaacaatacgcagattatgcgatggcacagatgcggaggtacggcattccggcctccgtgacgctggcacagggcatactggaaagttccaacgggcagagccgtttggccgtgaatgagaacaaccatttcggcatcaaggccacgcccgaatggattgccgaaggtggccggtacggtctgtattccgatgacaagccgaacgagaagttttgcagctacgacagcgtgggcgattcgtatgagcaccactcacgcttcctgaaagagaacagccgctatgcccgctgtttctcgctctcgcccgatgactacaagggctggacacagggcctcgaaaaggcgggctatgccacgggcgggcattatgccgacagcctgcaacgtatcatcgaacagaacgggctgcaaaagtacgaccggcaggtcatgcaggaaatggagacgcagggaaagcggttcggcgtggaagagaacccgctccgtgaggtcggaaatacagtggactattcgtttccggtggagcggaaagagtttcttttcgtcacctcgccattcggtatgcggcaagatccggcagacggcaaggaacgtatgcacacgggtatcgacatccggtgcgacggcgatacggtcctggccacggaaaaagacggcaaggtcgtcgctgtcaaagacaaaggccatgcacccggtaacaaatcgctgaccgtggaatacacccgtccggacggcagcaaggtacagtgtacctacatgcacctcggcgaagtttccgtaaaggcaggcgatacggtacaggcaggccagaagctcggccgttccggtaacacggggacacggacgaccggggagcacctgcacttcggtgtccggcagatttatgcggacggcacgcagcgggacgtcgatccggcagcgtatctggctgaaatcgcacaaaagggccacatcaaacagcaggtactacataacggcaacgacctgctcgcccgatataagggaacagaagagaatgccaccggcaaaagcctttcgcccgatgcgtggatgaaaaaactgctctcctcggaggatagcggcgtgggattgtcggggtgcagtgatcctgtcgtggaaatggccatgaccgcctttacctccctgatgttactggcgacgcaaatcgacagcaagaacaaggaggaacaaaaggcagccatttccgaggcgatggacagccggcgtatcgacctcaaagcgttgctgccgggcatgaaaacctgtgacctcacagtcggggaaaacgggcgagctgtcctgcaggcggacaacggcagcgttcaggtatcacgggaactggcctctgccgagttaagccgcctgtcggtgacgctgaacgacagttctctttcggaggaagccaaacggctgcgtgtgaccggcgtgctgaacacggtcatcctctcggaggcggcgtcgcagaactttgaacggggaatgtccgaacaacgggcacaatcggaaaacctgaaaagataatcccaaaaagtcatgataaaacgcgtgatgatacgactttgcgggtacttgtccggggtgtccgtctgcgccctgcatatcctgttctgttcccggctattcggttgggtagcaacactcgttatcgtgggcgtccaactgggtattgccggctggattgtctacatgagaatacgtgctcccgattaggaaacgctttcaacctgttcaacttcaagacaccccgctttgtccggtggactatgtatcactaaaagacaaaataaaatgattaaatgcaatattacggcgtgcggcaccatcggccgcgacgcttcgatgcgcacgaccaaagaagagaaaacattcctgacctttccgctccgcgtcgtgctccaaggcaaggacggtcggaacgaaacggtcgagatcagtgtcagcaaggagggcggtcagaagaaggtatccggctatcgaaacggattgcgtgtcgaggttgcggggacgctgttcctgaaacgccggggcgaaaagctctatttcaacctctttgccgaccgtatcggcccggcggcggacatcgcggattccatcaagggcgaactgtcgttccggggcaaggtgggcaagaacatcgaggaacggaaggacaaaaaggataagtcctacacgatgttctctgcattcagcaccgaaaaggtcgatgagaatttcgagtaccaatgggtgcgtttcttctgcttcgacaggcaacgtgaagagtggctgcaaccgggcgtcaaggtagaagccaagggcgaaatgacggtctcggtacataacgggaagccggacatctcctgccgggtggaagaactggcgcaatatattcccgaatcggataacttcaatcagtagcagtcatggccggttatagaaagcgaaatacggaggggccgagcagcgaggacaaggcgctggacctctttgccgagatgatgatcgagaaaatcgaaagcatccacaaggactggcataagccgtggtttaccgagggggcactgcaatggccgcgtaacctttccgggcgggagtacaacggtatgaacgcccttatgttactgttgcattgtgagaatgaggggtacaagattccgcgcttctgcacctttgactgcgtgcagcggctcaacaagcccggcaaggacgggcaggaattaccccgtgtatctgtactgcgcggcgagaaatcgtttcccgtcatgctgaccacattcacctgcatacataaggaaacaaaggagaaaatcaagtacgacgactacaagaaactctccgacgaagagaaggcgcaatacaatgtctatccgaaaatgcaggtgttccgggtgttcaatgtcgcccagaccaacctgcaggaggctcgaccggagttatgggagcagttggaaagagagaacgggaaaagggtcgaaaacggcgaacatttcagttttgggcctgtcgatgcgatgataaaggacaacctttggatttgtcccatcaaaccgacgcaccaaaacgaagcatactactcaatcacaaagaacgagattgtcgtacccgaaaaggagcagttcagagacggggaatctttctacggaacgctgttccatgagatggtccattccacgggtgccgaaggtgtgcttgaccgactccaacctacctctttcggttcgaaagagtatgcccgcgaggaactggtggccgaactgggcagcgcgttggtcgcacaacgctacggcatgaccaagcatataaaggaagacagttgcgcatacctcaaagggtggctcgatgagttgaaagaatccccacagtttatcaagacaacgcttctggacgtgaaaagagcttcgtcaatcgttactcaaaaggtggataagattgcgcaggagttggaacaaaatgttaccgaagagcaagaggacaaacgctctgccaaggaacgtattttttatgcttcggtggcctatctccaaaccgctgacgacacgaagcaactggacgaattgaaggacaaaggcgactacaagggtctgcttgcgctcgccaaggagtattacgacggcaacggcatggacgagcagcatacatacgcttctcccctccagaaccggggcgatgacctgctgattgaagataaggactttgccgtggtgtacaacggaagtgtcggaggcacatacgacatcatgctgaaatacacggaacaggaggtgcgggaccatatcacacgttacggcacagaccgtgccagcgatgatgtgaaagaggtggccaaagatatggcggcggaacagtttgctgaactgacacatcagagaatgccggtattcgaaatgccaaacggagatattctgtatgcaaggtacaacagggacaaggatacgctggacgtgggtacggccaccaatgcagggatggccgtacaacatcattacccttatgaccacaacatgacgctggaggccaacctgcaagccgtgaacgagaagctgaacgagcttgaagaatacagggaggagctacaagaggcggaatatggcggcggtctgcgtcggtaacggcagcgtaatatgaagaatgtggagcgatttcatactgaaggcgctccacatccttatagtccctaccggttttcattccgctacagactatatgttatcattacgacagcagtttgtcaatcattgactgtaactgcagcatatcgcaatattgattgtttccgccggtataatcctttgcgtgccgggcagtccgtatcatgaacgaaccgagttctatctttatcccatcatccatccgcacatccgcagaatggtttatgtatacaaacttaccattacgttcaataaagcaacttgtataataatgccccttattctcggatacgaccgccgcatccacggcttctgcatatttggatatttcacgtagcaatgccgtttggaaattactgtattcctttgaaacataagtttctgcgtctgcaaggacagaagattgccattgggtataaaaagtctgtgtcatattctttcaattctaattctgtaaataaattaggcacatagcaataaaagtattgaatttatagtattcaattaacatttaagcaattaccatgatgttttcagagaccaaaattacggagatttattgtatgacagatgatttttgcaaagaaattgctcaatttcaggaaaaatatatggttgaagataaagatattgaatattccatgccccacttcctttaatataactttatttccaactccctttctaccataacagcatactgtttttgaaagaagcccgccattgatgtatgtttttcaaagacgggcaactggctatattttgaattatactcacgttaaatagctttcccaattctctttgtcgatagttaatttgttcatttcccaatcgtattccacttccggtatatcggaataagggaagtgcacggtatagcctatctgtccgtaggagcaatgcagcggtacaacgcaaatttcctgaccgcaataagactgtggcgtacagtatttcttccaatcaaaacggcctgcaactatattgcagcagagcagttttagagccattatgcctttccaactctgaaaatctttcttgtaacttgctcttttcataatgaataccatttaatgagccatgttgtagtaaatttcgggttcgctcgatacgttgtaaatctgactcccgcaacgtaccaatagggcgttttttccgtagtaaagctgcttcatgccggttatgttccccgtgcggtgaaagtttgggaaacggcttattcctgccttttcggcgtctcgtgtgtagagggttttcgttctcattgcatggttgtttttaatgtttcataaagtttttctatcatggcttccgcctgctccatatcgctcacgatgtctttgattcggtaaggtgcgccgttcttgccatgcccgtccgtaccaatccacaggtaggcttcatagtcggggtcgaagtcttcgtaatatgtttcaacttcctgtaacaagctgtcggtgtcattgcctttcatctcaaccgagaaactgaaatcctgcccgtgaggtgtgtattgctgaaaatcgaacaccacgaggttcggtttgtcggtatcggttttaacttgccagcctaattgttcagctatggcgataatctgttctattgctgtcattgttctgtttttttatttcccttttcttgaagccttccgacttcgcccaaagggttgatttttacgtgcaattcccaacggcgaaagcaagaacagcaggcaaggaacggaggttaaaattttatgaaatgccgcaatctgcgattgcggaaagtttgcgtcaaattttatccggagtagcgaagcggtacttgacacgctgttcgttcgccgtacctttgctgcgtaaaaacaggccgtggcgatagtggagattccatgaaatgatacgcccaagcatacaaagggaatggaggcaaagatctccggccgttacaacaggaaacgacggcagtatgtgtctggggtataaagggcaaaaaaaacgtcgaacgattgtccatcggacaaaatgtaagggaatggaaaaagaattgtctgtataacagaatgttcgacatggcctttatcgggaatatgaacaaccacctgtcccgattggcaggtggttgcccgatataacttccgcagccggtatcaggcggccatgcgctttcggataagggcgatgttcttatgcacgaggttcataatccgcttgtgatatttcgtatttttattacacagtcctctcgactgcagcaccttgaatgtttcgaggctcaattctacggtctcgaccctcttgtcctctatccgtgcggagaataccagcgtatccggtttgaggtaatattcgcactgtcccacgcagtggtgcaacgcattaccctcgtcgtagtaggcttccacgctatccagtacacggacgactatcgttccgtccgtgaactccagaccgaagaacttgcctttcaactccctaaaacgtgcctcgttttccctcgcccgtttcatctgctccttgcgtttttcctgctcttggagaatacgcaccttgttctgatacttgtcatgctcggctttcaaatcggcggggcaaacatagtgggcgttgtgcaagtccttgccgcatctgtcgagcatacggagataatccacccatattccaatgtccgttatccgatacttctggcgtaacacgattttgtaggacggccaacagaaatccaaatcctgcgggtggtcgatgaagtgcttgaggtctcgtttgcgtccacttttaagtattgtctccactcggctgtccgatagcagggctttcatcagcttttgcggggcgatgtcggcaaacgaccctttcagcccgttgcgccgtaacttcgggataaccgtgtagcccggacagacataacagtcggctatgcgttggtacacgtaattgtcgttccgcagttccaatcccgacccgtacagaaagctgtccaaataacaccccattgtccgttgcaaggctgtcaaagcggttttcccgttctcgtccaaccagtatctcgccacttcgcacacgtctgtccatgcgttcttgcctttgcggtaacagacattcattctgaaaatccgctgcacctgaaatccgtcctgcgtggtgatgacagaaaaatagcttttctcatctgtcttgcggcaaagcgtgtctttgagcgtcagtttggcgtggcagttcgggcaatggcaacgcttcgcctttgtctcgttccacctatgaccgcaatcgaggcaggtcgtttgtccgctcggtgtacgaaaagcgtaatgtccgacggtatgccggaacgcccattctgcctgtttctccgtgataggcagcaaccgcccgttggcggctactacctgatgctgaaattttgtccgtgctttcatggtcagaaatcgaagagtgagagttccgtttgggtattctgtacagctttggcggtcggcttcggcctgctgtggcgttgctgtatcttgcgcatttcttcctcctgataggctttcagcgcgtcttttcgggcttgcgccttttcttcttcggtcagctccaccttgtgattgaccacgacgccacaactgataggtttgcccacgtcgatgttgtcctcatcatagtaatgaatggcgagcgaccacacctcgtcgtcggtcattccgcaacagccgcttgccttgacttgattgagaatgaatgtgatacaatcgtccaagtttttgttttctttggcataggagacggcgaaaagttcgtccgtccgtgccttgccgtccaagtattccttgatagtccgtttgaaatgttccgtacctttcatcgttcagcgttttgaggttaaaaatgatagtcgatgacaccgccgatgtaaagcagcgtaccgggtttaaattcacatgcctgccgcaggaactcgtaggattgctcggcgttggattgcagcccctcctcgtccatgtagaaccagtaagcggtatcgagcgggtttttcaggaacttttcgagttgatagaccgggccaatccagtcctgcacgctttcgggggtaagggcttccgccctgcttcgaatgtctgcgatgaaatcttctctccatcgttccgcaccgcctttgtagcgtatggtatcgtcggaaacaagctcgaacatgcctttgggcagaatgttgtttaccaagttgtcgatatggaactggcgttcctcatcgtcaatctccgcacaatagtcaaagaaactatcgtcgccctgcgtgagggtgtcctcgttcaggtagttgtccttgctcacccgtgtttcggtaatttgaaaaatcttgctgtgcataactttaaatttttaatttgttgaacttgcttttttcttctccctgctttcggagcctttcggcttccttggcgggagagattttacatgcaagccagacagcggggaaaggacggaaaggcaagcaaacggccggagaatttcacggaatacccaacccgtcgaggtacgaggcgggggctgaaaggccatcttcgatttgcggaaggctgccgggcaaatccgcgagccgttagcatagtggtgcttgacgccggacgaccgctgtacctttgcatgagaaaatccaaccggcgaggaggcaacgggggcgagatcagggaaagaatgggataaccggaataaaagaggaagaagcccgattgtatatagaagtgggaataacggctaaaaaagaaaatctgcctgtgagggcgattgacaaaaaaagccccctgaaccttttgaccgtccaagggacttcacgtgcccggcaaagcggaattttcggaacgcgagccggattataaggtggcttttaatcgtaatgcataattcaacagatattttcctgaatcggaaaactcttttttatttcctgtatagacatacccgtggctctcataaaattttcttgctgcaaaattttcttccaacacccacaggtaaacctcttttacatcgtgactttttgctgttgtaaggaaatggcgcataagttttgtcccaacaccttctccttgaaagaacggatctacatacaactctttcaattcccatatactgtttttacaatccagtttcatcatcccctttacaatcccgtcatcaaaaacatatatatcgtccaaagctcctataacatcctgataatataatgcaagacgcaataccgacatttcattaaaggaaacatcatcgttttgaaaaatagggcgaaaggcttttcttttagagaaaatctgtatttccgcaagtcttgaagcatcctttatcgtggcaactctaatcatttttttgtttttataattttgtatttacatattattttcccaaaagtttctgttcttcacatactatccggcactgtttccagtatgtttttttcagaagcaaatatataaaaatcaattccacaaggtgccatgaacgactttttttattaagattcacaggaatgtgatataaaagagtttaactcctccgacgttcctttgcagctgcatagggtgtcgtgtgtcttgccttgatttgtcgggtaacgtcaggagcaaaaacgggaaacgctatcgggaggtagaaaggaatggaaatggggtataagggttataacaggtggacgtccgcttaaaaaggaatttcttgtgacatgccgggtatggcatataactggagagacgaccttgcggaataaagcccccgaaaccggctttgcaggttcggaggcttgtgccgcatgaggctatttatcagcgtttgccgtgcgcctgtcccagaagatagtcttgcagggattggtagcggttttgaatattagcgttttcattgaaaccgttcaggcaatgaagcaatgctttttcgagcgtgatgtatcggcggctgaaagtctgtacgttatccaagcaacaggcttccaaagcgtatttgaacggtgcaaaattttcaggttctttccgaatccgcacatgccacaggaagaacaactgaatcgtgaaactgtcggattcacctgctttcatcaaatgttcttcatcgagcaaccgtcggacaagctccggggtaagctggcaatcatttttccggtaatacatgcgttttgccgtattataggctgcaaactgttcgatgtcctgtgccgtctgcctgtatacttccgagtaaaatgcacgtacttctttacctgtaacaacgattttctcgtctccgaactcgtattcatacgctttttcatcggagatttcctcttctgttaaggtcttgaacccgtaacattccgttacgatgaacggttcttttccgaactccgccagagattcgagggcatggaggctgttgcaggagaagaacatgtcgtttccaatactttcaccgctttccagcagccggatttttacgtcttcggaatcgttggtgtacttccatactatccgacaacttgcataatggggcttcctgccgttcgcctcgacaaatccggcaaatccgctcttgatggcggcctttgtcttctctacatccgtcaggacgcttcgtgccttacaggtttcgcaccggccgaattgcaaagaatcgtcggaaatttccgttatcactttggtgttggggtttactgtggcttcgcatactacctgcgtaccgccacatcgtgtacatattatactcatatcttgtcaagattaaaaattaatatatctttctatccgctatattgaacttgtcgataaggttcagccaatggctgcaattccttttcaacaaaacaatttatccagattctgcttaaagcgtagcattaggcgacacttcccatcgcatttacgaaccgaccccatataggcgcattgaccgcttgtttcatcaaacaaaaaacatgactgccggaatgcctcaaaaattcttatcttaacctgttcgtccagaactttcccttccataatttgattaccatttgcgtgcataatacataaaagttaaattaaactccgagttatttatttccctcctctcggaagcttttcagctttccttgccgggagagattttacatgcagatcagacagcggggaaaggacgggaaggcaagcaaacagccggggatttcacggaatacccaacccgacaggcgcagcaaggagggaactgaaaggacatcttcgatttgggaaggctgccgggcaaatccacgagcggttagcatggcggtacttgacaccggacgaccgctgtacctttgcatgggaaaatccaaccggcgagaaagtggcggaaacgagataagggaaagaaggagatacgatagtggagtaaaaggggaagaagccggactgtataaaaaagccggaacattggctaaaaaaggaggtcgttccgtggaaacggcgtacagagaaagtcctctcgaacttttactgtccgagagggcttatcgtctactctataaaatggtaatgggcattttggcattctccgttcgattgtgtcttttgcaaaacgtcatcgacgctggaatatcggctaaaacagccgttatatatctgcttgccgtcgagcgttatccgttgcaggtaacagccgcatactccgtcacggctacggtcagcgacaaaatagaacacgataccgttgctgtacgacaatcgcaattccgtatagtttatctcggttttgggctgttcggtcggcagacgggtattgaaataacccgtagccagcatgacctgtccggcgaaacgcatggcttctgcccgatattttttcatggccgaagccacggggctttcgtcccgaccgtttccgacaaacgatgcgggcaggcttctgttcctgtaagacagtttgaacatgccgacctcttcctgcaccacgggcaggccgacagcttcgtactcctctttcgtcatttcgatgaaacgtgtgcgttcctcgtccagatagaggcggtaagcgggtttcacccgctcccgcttctcttcatattccgcctgttcccgtgcgttcatgcagttataaacgtgtcgggacactctccgcaccgcattgacgaaagtcgggcttttgcatatcccgaaatgccgggcgaagtcgggtacagtcccgataaagccgtactctttccaatgataggttctcatggctgtctgtccgatttaatccacgaccacatattcattgatactgcagcaagaatcggggttttcctgcgcccattcttcaaacagagccttggcatcctgttccgagcggacggtttttcctgcgacctcgccaagccacgcaaacaggctctccctgtcggcaaaatattcgcagaagtatttgcctttggcagtacataaatcgactatgtatttgtcggtaaaatacttgccttcgctgtcgttggtctcgtagaagcccattcccggctcttcggtctggtaataataacggagcgatgggaatttctcgcacacgaggtcgaatgtctcgttgcatggcccccatgccgtctccgtcgtaaagcggagggtttcgcctaccatttcgaggtttgcccaatctccccgacaactcaccttgtcccagtccttgcccaaggcatccacaagacaccccagccatgatgtcccgaagccgtttttcacggcaggcgtttttctgtcctgcaaatctttcatcaactcatagaggcttttgatttcctgcgcgtcgccctctatcacatacgctgttgaacaccagtttggcataatcgttaatttttattcgttaaactttttcttcccttttttcggaagctgttccggcttccttatcgggatagattttacatgcaggccagacagcgggaaaatgaggaaaaggcaaggaaaccgccggggattgaacggaatacccaacccgacagcgcagcacggcggggaccgaaaggtcatcttcgatttgggaaggctgccgggcaaatccgcgagccggttagcggagcggtacttgacgaccgaatgacgctgtaccttcgcatgggaaaatcacaccgacaagggagtgcggcagggagcgataagaacgagaataaataaaaaggagaggtgaacgggatataacgggtatagaatatggacttgaaaaggaaatttttcggtataattataataaggtgtttccggacacgaggccgggtagccgtcttgtctctgccataaccgaaaggtccagcgaacaatgaataacgcagcatcgttcagcagtcagaaacagtaactatgccgtcgtactgatttacgacaatgccgataaaataaggaaaagccgaaaagaggggcttgccttctttccggcttttcgtgaaagtcctattatccgggcttcccgttattctatacggtccagcctgcggacttctcttgaatcgtccacagacgggcataaagcccctcgtgccgcatcagttcgtcgtgcgtgccttgttcttttacccgtccgtcttccagaacgacgatccggtccgcattcatgatcgtcttaagcttgtgggcgatgacgatgacggtgcgtcccttgataagcgtgtcgatggctttctgcacctccacctcgttttccgggtcgagcgatgcggtcgcctcgtccagcaggataatcggcgcatccttcaagatggcgcgggcgatggatatgcgctgtttctcgccgccggacagcgtgcaaccgccctcacccaccatcgtgtcgtatccctgcggcaggcgcatgatgaaatcgtggcagcaggctttctcggctgccgcgatgatctcctcgtccgtcgcaccgggctttccgaaacggatattgtcgcgtatcgtgtcctgaaacagatagacgtcctggaacaccatcgagatgcggctcatcagactttcaggttctatatctttcatcggaacgccatcgaaaaggacacgcccctgctgcgggtcgtagaatcgggcgcaaagtttcatcaccgtacttttcccgctccccgaaggaccgacgagagccgtcagcgtgtttctcggaaacgcgatggaaacgtcctgaagcaccttcttgtcctgataggcgaacgacacatgctcgaaccggatgtcgccggtggccggcgcctgccgttcgccttccatctccggctcgttcatcagcgtgagaatacgccctccggcaatggagaagtagcggaactccgcaaagttggtcagcgccgaagtcagcgggtcgaacacgcgcgagccgaccacgaggaacagcacgaagacgagcagcgagagttcgcctcccaacagcaggtaggttccgcacagcaccatcagggtcagtccggcccgcaccaatgtaatgctcagcagcacgaaaggccccagcatggcttcctgacggatacaggcacggcgcagttccgcaaaagcatcgcgcaggcggacaaagcggtcgcccagcaggttgtaggctttcatcacgcgaatgccctgcaagtattcctccaagcggttcccggcattgattttggcttgtatctgcctgccgctcaactttttctgcacactcgtgctcatccataggacaagcaaggcgaccggcagtgcggcgaacatggcaacggccatccgccagtcgatccataccagcgagaggaatgccagcacgggcatgacgacggctcccatcagttggggcaaatggtgggaaatgcccgtctcggccatcgtgaaatcggtaacgagcatggacgaaagatcgccggggtcgcgccgggaaagaaatccgagagagagtttccgcagatgttccgccagtgcaatgcgccccgacgcactcatttcgtaggctcctctgaaattggcccggtaggaggcccgttcggccaaagccatcaccagcatatagacagccaatatgccgaaaatgcaccacagtcttgccgtgtcgagcggtcgtccgctgccgtcgaacgcggcgaagatgatgcgcaccgcctcgatggagaggcagaaaggtatgatgttgaccagattggcgagcatggtatagcccacgggcttgtaaagacgttccgtatggcctatcgtaatgtttttaatcgcattcatgttccactcctttcatttatgtgcgacgatatgcagttcttcttttttctgaattacccggatgtcggaaaagccggcttgggacagcaactgtttcagttcttcggctccgtacaccgtcattccctttatccgctccgtccacgcctttccgagttcggggtcgctcgcttccagactgatgagaaagcagccccctttccggatcacgcggaagacttcggccagcgccttgctgacggaagaccagaaatagacggtctcgaaggccgtaacggcatcgaaggccccgtccccgtaaggcagggagcagacatcgccctgctgtatgaaacatcggcggtccagttctcccgcattgtgcctgcgggcgaaggcgacgctctcctccgacaggtccatgccgtaaacttttccctgcggacacagcttcagcagacgcttcacgttggcgccgcccccgcatccgatgtccagcacattccattccggccgccagtccacctgtttcatgccgcgatgggccagcgaagcgtggaaacagttcattccccgcaaaatcatccgtccccagaatccctgcggacaactcgtattctgtaaaatatcgttcaagaaactattctttttcatatctccgtattcaatttttgttcaacttccaatgataagcgctcgtataggcatcccacatgttcttgtagagcccctcggcgacggataagtcgtcgtgctggccctgctgtacgatccgtccctgctgcaagaccacgatgttgtccgccgagacgatggacgacagccggtgggcgataataatcacggtcttgccttttatcagggattgaagggcctgctgcatcttgtattcgttctccggatcggcgaaggccgtggcttcgtccagtaccagtatcggcgcattcttcagaatggcgcgggccacgcatacccgctgcgcctcgccgcccgacagatacacgccctcgtcgcctattctcgtctcgtagccttgcggcagccgctcgatgaactcgtggcactgggcggctttggccgccgccacgaccgtttctttcgttgcggcgggggaaccgacggcgatgttctcgtacagcgtgtcgtagaacaggaacgtatcctgaaagacgaatgaaacggtatccatcaactgcgtcgtagcgatgttcttgatgttcacgccaccgatgagaatctcgccctgctccacgtcccagaaacggggaatcaggttcgcgacggtggacttgccgcttcccgaaggccccacgagcgccgtaatccggccttgcggcgccgtgaagcaaacatcgcgcagcgcctcggtacgtgtgccctgttccgtattttcgtaggagaatgacacgtggcggaactccacctcatacgactgcggcacttcggggtgttccggttcgggaacgggctttttctccagaatgcggtcgatacgcgccacgccttcgtcgatctccttggtgtttccgcccaggaacgtcagtttgtagatgggcgaagccacacccggtcccatgatgatgaaaaacagccatacggcggccaatgcgagcgactgcggattcccttgtatcagcaggatacccacgggaagaatgaacgtcaccatcgaacccagcaggacggtgaacgcgatcatcccgttctggtaggtgtcgcagcatttcagggcgaatgtcttgtaagcctgtatctcggcgttgaactgccggaacgagcggacgctctgtccgaatatcttcaccacgggcattcccctgacgtactgcacggcggaggcgctcatcttttcctgcgcatcatagtaaatactcatgaactcccgtgccttcttccccatgaaattggagaattgcagggcgaagctcaacagcaccacggccagacagaccgccgtcagccatgtatccagcgagaaaaagatgacgagcatcaccacgaccgtcgccactacgttcaccaaatcgggaatcgtgtgggcgatgaatccctcgattttctcgatgttctgctccatcgtcttcttgatggctccggtagaggtgttgttgagataacccagcgacagtttgccgatatgctcggacagccggacacgcaatccgtacagaatgcggaatgcagccacgtgcgaggacatcagggcggcgtacagcagcaccagtccgccgataagcccgcagaaggcgatccagccccaacgaatcatgccggcttcgtccaccgaagccgggcttgtaccgtgcgtcagcagctctttcaacacctcgtacaccgcccaatagggtacgagcatacacacggcgctgcctgccgacagcagacccgccagaaaaagcagccctttcttctgccccgcgatctcgaacaggcgggacagaccttctttcttcttttcttttgtttccatatattgaattttatccgattctctctatccgttgttggtaaattcctgtaaatcttccggccggattacaacagccccgtcagccgctccccgctcttttgtcagccggaaatcgcagcacgaagcaccgtgtgccaatgtgcgggtccgtgtcagccggataccgagtacatcgtgtgtgatataatcattcacgcagaaataggggaaaaagcactcgacgccaatacgggaacagagttcggcgaccgggcaccgggcaatgtccataccgacatcgaacgtatcgtccgcattcggcaacacgcaatcgaacagccaatcgtcctctgtggaaacatgcgaagcggaagcgatgcgacgcacatagtcgggcgaacacaacatttcgcgtatttccgaaattttttcagaagggatactcgacaacgtgagctttttcaatgctttctgcgtaacaatggaaagttctgccggactccatcctctggccgacagttcttgccacagaccgatctcataggctataccgataatgtttttcacccatggtgatgtcggcgggacatccggaatgattgcggagatacgatgaaaattctcgacagccgcttccatcacggaatcaacggattcgaccgacaaacgggatgccagttcttccctgaaaaattcttcgaaccgttccaacattgggagataaggttcaatcgtcgtctctttcatctttcatggagaattgccgccgtgtcacgggaattcgatacgatttcatatcccaacatcgaactgaacttgtagcacagccgcgtcatccgtcccaatatttgcccgaagaagaagccccagcgcggacggaaaaacttcatgtaattggcctgttccaaaaggcgtaggcggggttcccattgttctaccagacgcccgtcgctcagaccggagcggatttgcgcctcgtgttcacggagcgaatcgggtttcactccgtgacggctcatcatcgtaccgcagacgtcgaaccacagttcgccgcccccgaaacgctcggccacatggtgcagaaatgtttttacctgcttttcatagaaatacatcagcacgccttcgaccacgaagatgaaatgcgcatcgggatgccggcgacgcaggtcgtccagccagccggcatccagcagggaggccgcaatgtaggggttgcccggctgctccggaatcagctcgcggcgcagcgcgatgacttccggcaggtccatgtcgtagaatacggccttcccgtcgccgatacgctggaaacgggtgtccagaccacagcccacattcaccaccaccgcatcggcgtgcttccctatgaagcggcgcacggcacggtcgaaaaaccacccgcgcacgacgcagccgacctcgctcaacttcgccccgtcgaaacgggagtagtcgtattccagactgtccaccagcccctccgcaaccttgtcgttcagaatcgggttctttcggcggctctctttcgccctgtaatagagcggaatgagcaatgtctcggcgacaatgctctcgaatttatgtctctgtttcatttgttatgatatttattaatgaacgatattcagatttgttcacgaataaaaaaagaggaaacctttgtgaagatttcctcttttcccgctgccccgttacggcagcttgtccgtatgtgtcttttctatctgtcataccttgataatggccctccaaccttgaatttcaaacagaatatagtcatgcagaatggattccatttcctgtttgggcaccgcgtgcatcaacagctcctcgaacagcgtgaacatccacaccgtatgcaggtgaatgataaaatcggacacagccgtatttatattcgggtacttcttcttcatggcggcgaaccatgccttgaccagcccggtcgaacggtcggtgtagctttcgcgaaaatgttccagcgaagagccttgggcacggaacaacaggatctccagcaggctgcgatgcgtttcgatgagcgaaacgtattcgtcgatacaggctttcaggtatttttcggaacgcatcgtcatcacgtcctcgccgcgtatgccgtgatgctcctgcaacatggcttccatagcgtgcaggacgggacggaccacttcacagaacaattcgtccttgttccggaaataattatatatgttccccacaccgacaccgacggctccggcaatctcgcgcatggaggtcttggaatacccctgctgcccgaatcgctgttcggcgactgccaatatgcggccgcgtatgtcttctttgagtacctgcataaataatgaacgatgtttccgtttatatttttgcaaaagtacggggtttgaatttactggacaatacctatttatggtgattttacatgattgaaataagggaaaagcaggtattaccggaggtagcgaaataccttgtctatatccttgtctatatccgaaaggaaaagtcatattgttcattgaaaaggagaaagtctcatagattataattacttttgtacataaaacccaaagaatcaaatataaaatggcaaagattacagtaaaagacacaagtgtcacaattatatcagtcaacgagaatgattatatcagcctgacagacatagcaagatacaaaagcgatgacccgactgcggttatcgggaactggctgcgtaaccggaatacaatagaatatctgggtatttgggagagtttgtacaacccgagttttaaacccctcgaattcgaggggtttaaaaaggaagccgggctgaacgcctttaccttatcaccgacaaaatggataagtacgacaaacgcaataggcatactctccaaatcgggacgctacggcggcacttacgctcacaaggatatagcatttaagtttgcaagctggatttccgttgaatttgaactgtatattataaaggagttccaacgattaaagaccgaggaacaacagcaactcggttggtcagccaaacgggaactgtcgaaaatcaactaccgcatacataccgatgccataaaacagaaccttatcccggcagaggtaaccgccaaacaagccagtattatctatgccgatgaagccgatatgctgaatgtggcgatgttcggtatgaccgccaagatgtggcgtgagcaacaccccgaactgaaagggaatatccgggactatgccacaatcaatgagcttatttgcctctcaaatatggaaaacctcaatgcagtatttatagaccaaggtattccgcagggtgagcggttgattaaactcaatcagatagccattcaacagatgagaatattgggaactggcggcagcgaacgcaagttattaaagtagatgagtctctatcagaatttgtgccgagtacgtgatgaacaatacactatcaaaccatgacgaataaagatgaaatgacaatgaactctgataaaaacgcctattttctatcgcttccggagataaccgaattatccgttcctcctaaaacgatattgttggaagaaggcaaggtagccgacagaatgtacctgatccggaaaggttgcctgcgcctgtttttcaacaacgaaggacgggacatcactttccagttctttttcgaaggggatttcgtcgcgtcattcgacagcctgtatcaacggacaccgagccttttttccctggaaagcatagagccggcagaactgtcggttatgaagcgggaagattttttcagaaacctcggacagaagcccgcgctacggcagatatacgaggaaaaaatcatcgaacgcttccatgtttatcagcggctcttcctttcccgcataaagaacaccccccaacaacggtatgaagaactgctgaaagaacacccctctatcatacagcggattccccagcattatattgcctcctatttggggattacttctgtttccctgtcgaggatcagaaacaggcgatagttcatttctttacatttgttatcgtccggttccagtcgaagatgcgaactttgccgcatctattaaaaccgaaagacagatgaaaaagatttttataatagactggagcctgattcccgtgtttgtcctgtccgcatactccggaatcgaattgcatgtggccgactatgaaggcaatcacgaggtatggcataattgggcagttttccatgtcctgacgagcctgctgttcctcatggcctccatatttcatatagcgacgcattggggctggtacaagggaactgccaagaacggaataggccggaaaagcaaggtcacggcggtactgtcggtcctgttcctgtccgtggttctgaccggatttgccctgttaggcatagaaggagcaggttccccggtcgggcaatgtcatttttgggcaggaatcgttacaactgtcctttctatcggccatatactgaaacgccttccgttgctacgcaaatcattgaaataagcacaacctattcaacggacaacttccggacaaagcgttcttacagaaatcggggtacttattacaaatgcggcttcttgcttactgtcgagaagaccgcatttttctttatttttcggcatatcattcgatttcagcattgctcgtccaaccatttggggcatccggtccattcgttgccccttcaaatccggcatcagagaatggctgttgtcataggcaccgacttcatgcagttccacgaatgaggcatttcctccgtaacggtttatgtttttcacgagcttacggcctgtccggagaaaacatacgtgccagtttttcccgacgagattccgaaaagacattaaaatagttgaagaataaaatgttacgcatacaattatgtacagaatcctttcatttcgaaccatcatgccttatttataccggacgggggcaatgtcgctcccgtaaaataattaaggattatgataataggttatttaagggtcagcacgggcaaacagaacccggctaaccaacaagacgagatccggcgtttcgccgacagtagaaatctttccgtcagccagtgggtgacggaggtcgccagcggcaagaagaaggggtgcgaccgcaaattagggggactgatacggcgcatgaaacggggcgacacgctgattgtcacggaagtttcgcggctaagccgcacgctgacggacctcatggccatcatgggcaagtgtctggagaagggaatcaacctttacacaaccaaggaggggtattcgttcgacaactccatcaacagcaaggtactttgtttcgcgttcggtctggtagcggaaattgaacgcaacctgatttcgatgcgcacgaaggaggctctcgccctccggaaagccgagggtgtcgtccttggtcggaaaaaaggcagctacacgaaaatgaacgtgctgatcgaaaaccgaaaggtcatcgttggcatgttgaagcggaactgtacgattgccgatatatgcaggcgtttcgacatttcgcgggatacattcatgaaattccgtagccgctataaggaaatagataaggccatgaaagagaaagagataagacggaaaggggagttgcaaaaacggagggtatgattttacgttggttaaatcgttggtttaatcgttcgttttcagccacaaaattacaaaaacacgaattatccacaaaaaaaatctgcaaaaaattgcgtttcagttctttgagtaggacaaattttcccggagtgtccgaataatacgaccttttttccgatagtctttttaacgaacaaataaatcggcataactgacagttatccggctgattatttgttggttcggtgcttttttacctctaaagaaagaagcacggcacggacaaacgtacagagattgaataaatagctgatataaataaattggcatagacagaattatgacaatgaaacgaatactgttattatttcttttattctgcggcgggtatgttcatgcgcaagagttggactcggcccgtatccattaccggcagggccacagggaagtggacgtgctcttccgggacaaccgcgcggaactggagcgttttatccgcaccctgcgtgaagaacacggtgcggaccgccttgaaagcgtcgtgatacgctcgtgggcatcgcccgaaggtgtgaaccgtctcaacggggtgctgtcagagcgcagggccgactccctgaaatcctatctcgtgcgccacgccggaatccccgacagtttgatctgcatacatggagaaggtattgcgtgggacatgctgcgccagatggtcgccgcctcggacatattatacaaggaagaggtgctgcatatccttgaccatacgcccgtatgggtgttcgacaaggcaggtcgcgtagtggacggacgcaagaaacagctcatggacctgcggggcggtatgccgtacacctacatgctggagaatttctttcccgaactgcgctccagcctctcggtggcctgctaccggaaacccgaaccgcccgtaaaagtcatttcccaaaaagagacgaaagtgaaagagccggaaccggccctgcaacccgatagcgtggcggaaccggcctccgagccggcaacggtgcggaaggaagcgaccgtgcaaccgcatagaccgacagtacagcggttggccgttaagaccaacctgctctacgatgcgatactgatgccttcgctcgaagtggagtaccgtatcgccgaccgttggacggtgaacctcgaaggcgacatggcatggtggaataatgacggcaagcacaaatgttaccaagtagctacaatcagcccggagggacgctggtggttcggacagaagcaaggcagcccgtggcacggccactacctcggcgtgttcggcggcttcacgtggtacgaccttgaaaacggcaaagagggctatcagggcgaggccgaaatggtgggtgtcagctacggctacatgttccccatcggacggcggctctcgctggaagccggtatcggtctggggtacatgcacagcaagtacgaagaatatcttcccatcgacgggcactacgtgtaccagcagacaaaccgaatgaattacttcggtccgttgaaactgaagtttgcccttgtgtggcggttgtgggataccgataaaaagaaaggaggcgcacgatgaaagcaacgctacgatataccctcatggggcttacgtttgcaggattgacattcctttccacgagctgccggaaagacctgtgttacgaccacgacgagcatggtctttccgtgaaggtgaatctctcttccgactgggaacaggaatgggaacgtacttacgcctatgactgggaaaaattgtgggaagaggactggaagtacgactatgaagatttgtgtcctgctccggccgacggaatacgtgtccaagtctataccagcgacggacagcgtatagagagcaatctgcccgatgaaggaggacggatcgccatgccggaaggcacgcacgaactgttgttctacaacaatgatacggaatatatcgtgttcgatggcgtggccgcttcggaatccgccacagccaccacacgcggcgtgacccggagttctttccatgaattgcacgcgggggaacgtaccgtgaaccagcccgacatgctttacggggcatacatggaagaatacacggcagaaaaaacacttgccccgacggagctgccggttaccttgcgtccattggtttacacctatatgatacgttacgagttcgaaagcggacaacaatacgtggccttggcacgcggagccttggcaggcatggccgaaacggtctatctgaacgatgggcataccggagaaaccgcagccacggtaatgttcgactgtacgctggaagattacggagcggaagcgctggtacagtcgttcggcgtacccgactatccgggtgaacattacggacgaaacggtacggacgggcgaaggtacagcctgaacttggaggtgagaatggtgaacggcaagttcaagaccttcgagttcgatgtcacagaccaagtgaaaggacaaccacggggtggcgttatcgtcgtgagcgggctgtcgatttccaacgacgaggggctggaaggcggaggcagctttgacgtagatgtggacggctggggagaatgggtggacataccgctgcccattgactgaaacgaataaaacaacaggtactaaataaccaaatttttaatttaattttttacatcttatgaagaaaagtttttttgtgcttggagtggctgtagcagcactggcaagctgtacgaacgaagaagttgtggatatgccgcagagccgggcgatccagttcggaactttcgtgaaccattcaacgagaagtagtgtgactgaaacaacggagcagaatcttcagaagttcttcgtattcggaaactatgatgattcatggacttccgtatataccaatgttcaggtagacggaggcactgtaggagcggaggggacggtttggaatcccacacagactgcttattggataaatggcaagaagtaccgttttggcgcttactccaatggtggtaataaaattgagaatgcagagtttaatgcaacctctcgagtgttgacattcccaaattactcggtagacaatacgaaagatttgattgtggctataccccaagaggtgactgcaaaagaagctaataatggtccagtaaacttatctttctaccatatgttgtcgcaggtgaagttcacgttcaagaacacggacgcttatgactacaccatgaaaatctccgacatcaaggtgaatgcagtaaaaacaactaatgttacagcgacttatgccgaaagcgggaaaccagatatcaattggactactcaaagtgtttcaacagaggactatgatttcggaacattaggggatattgccgaagactttaaggacgctacccacactacgacctgctttgtcattccacaaagcaacgaaaatctggaagtaacctttaccgcaactttctatgatgcagcaaataaacaattaagtgaaaatcagttcaaaggaaaattggcatataaaggcgatgttagcggcacagtacagaaccaatggactgaaggtttcaaatataactatacagtagaaatcaacggtagcacgattgatccggagttgaaggagcaggtaattgagttcaaagttattgatgtagatgaatgggctgacgcatcaaatagtgatgtaaccccggaaaacgccggagagtaatcgcttgcatcaatagccgaaaagacatcacatcaggctatgaggggttgaatgtcccctcatagccactaacgggagtgttgctccttatttacgctaccggtagcgtcagaaataaccggatataaagaaacaatgtatgattatgaataacaacctattcaaaaccttgttcataccggctgtcgcctgcctgctgggagcctgtacggaaagcacgggcccggacatggaaacaagcggcaacagcggggcgatccgttttgccggtcccgccgtgacacgggccgccatcgacgacgcggacggaatgttgaccgatggaaactcgttcagcgtatgggggaactacaccgacggaacgggcggtacggccacgagcgtgtttaacgccgaaaaagtgacatacgtttccggcatgtggggttacgagggcacgagatactggctccccggtaatacctacgacttctacgccctttatccgtctgtggaaacgctgggcgatgccgtgtcctccgccacctgcacggacggcacatttaccgtcaagggcttcgacgccacgaaaggacacgacctgatgacggcgaaaaagacgggtatctccgtcatggcaggccagacagagcctcccggtccggtagccctcaaattccaacatttgctggcacgcatcacctttgcggcacgcagtgagggtggcaacgccacggtacattccatctcccttgaggggctggatgtcaagggagattacgacagcggcaaggaacccctgtggagcaacacggcagagggaaccgtcagcgtggagaaagagacttccgtaaccccagccggaaatgcggacgtgtcgggcgacctgctactcattccgcaatcgctcacggacggggtgaaactgactgtcacctacgataccgatgccgagaggggaaagaccgcttcctacaccttgcctgccaccaccgtgagcatgtgggaggcggcgaaccattaccgttactcgttcaccctcaccggcggaggctatatcgtgttcgactcgcccacggtcaacgcatggagcgacgccataggcgggaacgtaaccatcgacgtgacccaataacccaattataagctatctgtaacttgacgataaaatgaacatccaaatgaagcaacgatacatacttccggctctcctgcttctctgctccgcctgccagcaggaggaatgggcgcagcccgaagccgacagtcccgacgccatccactttgccgccccggccattaccgtggagaaactcacccggagcacgttccacgacgcattccccaccggcggcacgttcggcgtactgggctactgcgtgccttatcagcgtggcagtaacaccgaaaaggactgggcatcgggcagcgcgaactggggtaacaagagcggcaacgccttccccgacgtgttcttcaatcaagccgtcacctacaacggctcggcctgcacttatgactataataacagtggcggcccgcgaaaatggtacaacacgacggaaaatccggcggcgacctcccccgacagctatcggtacacctttttcgcctattacccgaaggacggttttacagtggaaagtcccgccagcgccaccacacggggcgtgccgaaactgacgttcaccatgccgttaggcgagacgggcgatgtagcgactaccacgttgaacgacatgcagacacccgacgcgatggtttccgtcgtctataaccacctgcgtaccacggggaacgtgggcttcaatttcagccacatcatgacgggcttgggcttcgccgtgaacaactacaattacggagatgaaaagaaggaaactgttaccgtcaagcgtgttaccttgtcgggccacttcacccgctcgattaccatcgatttcagcaagaataccaacgaagagggattctacacctacagcggcacctatcccggcacatacgagatatataacaacgagacagggcttgcagtagctcccaacagttccgtcagcccgataggcgacaagcacctgcttctgttgagcaacgccacggacggcacttatttcggcaaggacgtggaggtttccgtcgaatatacctacaaaggggcggataagaccgctacagccgaacgtccgacacagttccagccccgtgcgggtgtccgctatacggcgcagctcaacttcgtgggcgaaaccttcgcgctgaactttattgccgccgataacgagttctgggaagacgggggcgacagcgacgtctctatccaataaaacaacaaccgaaaacagcataaagatgaaaaagatactttattatttcctgccggtggcctccatgctcttgccggcagcctgcaccacggaggaggactttggcggcggtaccgttccgcccggcgacggattcaccatcgaggccgtctgccagaacatgctgccgcagcaagtcgtcacccgctcggccatcgccaaggacgacaaggagaagcgcatcaaccagctctacctgttcttcttcgacgaaaacggcgactatctggaatcgagcaacacgaaagtattctcgccgtatatggctccgtcggcgaatacgaccaatgtcagcattcctacggacgtgtttaaagatccggcattcgcaaaaaaaactaccatctacgctttggccaacgtgactccggaggtggtaactgatgccaacggcgacggttatcccgataatttcccccaatatagcaaagacgggaaaaagcccaaggagctgctcgaagcgttcgtgtacgatcctgccaattatactcctaacacccgcgatgacatcacgaccctgcccagcacgggaatgccgatggcgggcaagagcgcgaccgtgaacctcaccgagaagggaagcctcacgatgcagctcaaagcactgatggcccgcatcgacatcaacatcagtatcgattccgaccactcggacgagagcggacaactgccccgcctttccattgcggaatggggcgtgtacaacatgcctaccgccgtacccctgaccgagcctgccgatggccagaccagcctgactaccgatgagccataccgcaatgtagaaaacatacagagcgatgccgtcgtttacaaccacggcggggccgcctccctgaccttctacatgttcgagaacatgattgaaccggacgaagatccggaaaactatcagtatccggctggagtagaggacgatgttgacaagcagcggtggaagccgagacttgtaggcgaaaacagcaaggctacctatttcaagatgagagcctactacactacctataacggcgacccctccctgcccgcaaatcaggataacaccaccatcgaggccgaatataccttctatctcggaggcaacccggtgaatgacttcaaggtgatacgcaacaggcactacgccaacaacatcgtcatcagcggactgacccatgtgggcaacaacccggaccacatcaccttcgatgcccgcgtcaacatcaccgagcagaacaacccgttctacctgtccatgctgcgcgagcgtgaccacgacgcccacttctgtatcacacctttggacgtgtacctcttcgaggaagatgagaatccaaagatgaaagtcagcatagccgacccggaaagtcacacttggatacgcatggaacgtgtgccagccgaaaatatggagaatggaacactctctgccgacatgagtacagatacccatttggcgaccggacagaaatggactgcgggaaacggcaaacgcaaatacttcaccacggacttggtgaccaacacccttgcccaaaacaccgaatacaccatcagcaggagccgtgaccgcatctatttctacttggacgaaaacctaagcacgaaagaccgcaccgccaccgtcaacatctcgtacaccgacaacaacacgcagacgccacgtacccgtaccattgaaatcgtacagcacggtctgttgccggtacagtggtattatgaaggcagacttcaaggcactatctacgtggaagcctatgaggaatatatatcccattacgaccccctgaacgagtttgaaggggattatatctatgacggtttggaatggggttgtaatggtgaatacatcggaggtccgctaaataacgaatggacggaaggaaacaaacatggggcggcagctacccggcgcattattacccaagctggacaatcagaaatgaacctgaacgaaaaaccccgctcagcggcggaatattgctataacaagaacaagcgcaatgccaatggagccgtacagggcatgagcaattcttccggttggttcctgcccggtatctcccaactggaaagtattcttacctcttattacaatacatacacggagttccagaacaatttctactggtcatcggcggcagcaaaagatagaacaggaatatggcctgcgtatatctatccagagagcaccagctatgcccgtgccaccaaggccctgccagacggtggttatgcagaaagtgattgggacgatatatacacgaatgataacggcactaccggtaaagcaccccgcatcaatagacctctccgcatccgtgcagcctacgtaccgcccagtggcgtaactatccagtgacaaccgccaaactttaattccgtgtcttactcactgcccgtctgtaggaaacccctctacaggcgggcagtgctgtttttattctcccggtatgtctttggcctgtacaaccgacatgcacacgcacgttttatacgtcggtcgggatagaaaaaggtgtgacaatatcaaaagaacctattcaacaaaaagaggtttgtagcctccccaaaagcccctcaaacctatggcaaaggcatcaaggggcttttcttctatcagagaaacagtaatagacatttgggttcgcgttatctgattgtgtcgtccgcaaaacaccttcggcgtcggaactttatctgtcatccgacagaaatacgataataaatataggatttctttaccgctttttatttcttcttcaagaaacgttccgtgagccatttgcgcaccgggagatcatagcacttcaggcaggcataggcaagcgcgaacgccccgacgaacgtgagcagcatgtaaggaaggccttcggcaagtgtcgcctgacggttgaacgcccatgccgtataaatatagaccagcggatagtgggtgatatagacgggataggatatgtcgcccagaaacttgcatacggcagcggagcgtttgcccgttatcctgcctcccgctcccatcgagacgataaccgggaaaatgcagatgatgcagaaagcctcgtaaagcccgttcatccaatacccgtcctccccaccgatacggggcgcggaaagcacggcgattatcatcaggctgcaccacccaaaagcattcttgcgggtgcgtatcagccagccaagccgggacaggagcagtccgccgaagaaggggtacatcagccggaccagtcccacgtactgctgttcccagttcaaagcccatccgcccacgatgtcgccggcaggtgcggtaaggcagcggtgtaccgtgaagcacgccgctatcgccacgaggacagtcaatgccgtcttgctgaacttgcggatgaacaaggcgtacaatatgttgccgatgtattcgtagtaaagcgaccatgccggcccgttcagcgggtgcatttccatccatccccggacgtcccacttcagcggcagaggcagcaacgtacaacccagcagcatgaccagcagcaccgcaccggcggacacgccctccattgccggataacagggggcatcctgaaaccaaaagagcgcggctcccacgatactccccatgaccaccataggctgtagccggataagacgacgcttgaagaaggttcccgtgctcatccggttccaacggtcatcgtatgcgtagccgatgacgaagcccgaaagcatgaagaagaaatctactgccagatagccatgattgataatctggttcagatggttgccgccggagtgcgcttccagcagatgaaaggccactaccatagcagccgccacgccgcgcagtccgtccagaatctcgtagtgcggcttcgaggtcaaataagagttttgcatgttcatgaattataccggtaaaagactgaatgcaaagatagtatataataaataattacgatgttcgttaccgattagaaaatatcaaacagtcagatttccgtttaaaaagagagccgatcttcacagacaggctctccataaacgaaaaaaaatgtttttatatcgtatgaacaaaaagtattatttgagatgcagcacaacctttgtatggcggttggcctcattgggcgcataatcggaaatgccgccttggtgagttttggttatcttgtcgcccgacaccccacgtttgattaattcttcagcgatataatcggctcttgatgcactcaagacattgtttacggatgctgttccggtcatactgtcagctgcaccaatgacgcttaccgataacccgtacttcttcgctactcttgccaactcgtcgagattaagcgtctgggaggtatccgtgagacgcgccgtattgagttggaagaagaaatacacgggtgagccgatacactcttttccgttctgcatacgagccaaatattgcatacagagtgtgtcttgacccgcacaaaggggaattgtgtcggcagattgtgtacccttcccatccaagggagatttcccgtcccacttccggttcttaagtctcgcttgaagcgagttcagaccgctgtaattgtttttgggataacggttgccgtcgaatgcatcgtcgtcatcaaaaagatggctgtacttgtcgagcaatccttcgatttccagaatctttttcagctcagcgagtgcccgtcggtctctgtcatgctgccctgcataaagacggttctcttccgacaaagcatttacgcgctcgacaagccactgatcgcggcggatataaggacttgggtctatggcgcgtttccaaccgaccctgccgatatgaaaagaaaatccggcggtaagcgataacatgtggtcaccaaaacggttctccttaccatacccgtcgaaatcttggaaagtggttgcgccggagagttccacgagggcgcttacccttttggaaatccggtactgcccctgtataccataagagactgcaaacgggttatgcccgttggtcgcatgatgcagcagcccgataccggcaaagggagccagatgccagcgtacctgttcctgacgggaataactgccgccgagcacattccatagcagatccgcatggaggtggtggtattcctgcacggccagcgtaccgtccttgaactgcaagccgctataatttatgcgtgcgcctacccacggggtgaaccacttgccaatggcaaggctatacgagggtttcaacctcccgaacaggtcttcgcagccaagcggggtgccgagaaaggccgtcgtgcctccggcgatactgacgaaccagttgccgtttccccgtgccgggacgaccactccgtcaagatatgagggctgtaacggctgcagcagttcagtgtcatcgtaacggaacatgcagcgtacagtatccttctccgtgggttgtacatccgcacgggcttgcagcgtacagaacgccgcaaagataaagatgatattctttgtcataattccaattttttaattgtaatctattcagttttcaggcaatctttgccatttatcgtttgggctttttgccgatggccggacgcatcatgcggctcgccattctcatgcagcggagcgcccatgcccggttgtcctcgtcgtcatcgcgtccccatttgaggtcactgccgccaccacctccgccacgtgtttcggcaaatgtagtggcatcatcgaccatgccgaggaacaacagtgtggcgcagtgcatgacttccgtgccttgttctgccacggagcgcacgagggtgccatcgaacagttgccgttcggagggcttcatacgtgccgacagttcccgccactcatcgaccatgttttccagcatggcatccttgagcaggctgtccactttggaatgtacatcacgggtgtattcgtaggcttcttccttaagctgttccgtgcgttcctgaatggcatccatattctctttgaggtcggaaagctgtcggtcggcagtctgtaacttctcctgtttgtctgccagtttcccttggatagcgaccagttctttttcgagtttctctttctcggcggatatggccaaggcatcgtcttttcgggagttcatgtcattttcgagtgctgccagttgggcctccttttcggatttctctcgtcgcaggttttccaccattgaagtgagaccctttaccctgcgctctgccagccgtatatccgaatgaagatcggaaagcactttttggtggcggtcaatattctcctcgatagttgtacactcttccgagagcatacggcggtattcttccgtcgtcctgtgccgtgcgccggtctcggcgacgctccggcctctcgccattccccatttcgtgttgacctcggcgaaaaagtccgtatggagctgtttcattctcgcactatattcgaacttgtcctttccggcgaatatctccttgtacgcaaacttcccgtctttgattggcagaagcgtgcaatgcacgtgcggattcaactcgtcgaggtgtacaatgaaggcggcaacattctgctctccgtatctgccacaaacgaatgaatagacatcctttgcccaacgttcgatgtcgctcttccttttgatgctggtattgtccgcacctttttcaaaatccaccttctgcgtaccgaatgcgagttcgtgcatccgctcccgcgaacctccaaagatgatgtttaccaccgtgcggtatttcggttcgatcagtccctcgttggggtcctttattccgcgacggcccaatatgtccgccatccgttccgggatattacggctcgtgtcaatagggcgtatcttgcctccggacgcaatctcgaagttcagatgtttgcgagtgggatcgtagttgcccttactcatggcgtacttctctgcctctttgctgcgattgcgcagatgttcgttgccttgggcggcggtgattcctttcgacacttgaacgtcaagaacctgttttgcatttgccatactgcttccgtgttatttcggacaatcccccgtgtcccagcttgctgcttgtacggacacccttcccaccgacgaatgtcggtcggggtattaggctcccccttccctttgttcagtggcagacgggcaagcccggatgcctgctataactggaaggatatttggaccggaaccggggcaaattacccgtggttatacaatctttgtctgcgaatccctgttcaactttcttcctgcgccttcgctaaaagcgatagaaagggtttacgaagcgattcgaggcgttccgtctcttcgtccataccgaaatccgttccatccggctttccgtcgataacaagctctgcaagctctttcgaggcttcgatgaacgccgcccattccccaccgagatcggaccggaagaactgcacgagcggtgagccgtcgtcgaatctcgacttgcgcagaacccgccatagggcggcatgggcgatacactccaaaacggtctcacgcaattgttcttctgatcggagggtatgcacggatgtcgtgccggaatggttgtccggataggcccggctgtcctgtccggttatctccgccaaggtctgacgcatgatttgtccgcatgatttgccgacatcgaaagaagttgctttgccaatcacccaatcgtacaatattccttgtattcttgtggcaaagtccgtttctttctgcccactgtccggcatgtcaggcgtgccgattcgcaggtgcatggtaatgatgacgcttttcgccagccggatacgttccaactgcccgaatgcttcgagcgtgtccagaaacgagcggacggtggcgcggtgccaatgccactcggatgcaaggtcggaaacggtcacatggcactggcagggaccgaggtcgtagtcttgtttccttaaaaacggggagacgaaacctgccagcgatttatccaacaggtcgcagtaggcttctgttcttgttttccgctcgccgactttttctttcagatagtcgaacacttccgtgttggccagtatggtggcgggtgcttcatttctatttctcattttcgttctgtttttgatgattcatatcgtgcggattgtatggactgccattatccgcattatcatggcagtcttgcgtgatgatactatgataactgtcggctaatgctccgggatattccagccattcgaggaatttgcgcatgtctgtcctttcggacatgacccttgccgacgggtagaacagggcagccaaaagaataaaggcgatggttacggacatcgtgtacagatgcggcacgaagccgatgaccaatgccaagagcgcaaaccagacgaaacgtttcggccggtcgagcaaacagcgcatccatcggtccgcccgccggaaagaggcccatgcggcacacacaatggtggatggcacaacaccgaactcgccggggtgtccgctcgtatagacataatggaagaggagcaatacgataagcagcacatgggtgtacaacctgcgggccttttcgctccatatcattttatcgtagaattttgccatgaagtaacgtctgctcctgtacaacagtgccggaaggacgacaggcattgcaagaaacacaaactgtaatataatccaagtcataacaggtaatagggttttgaaggtatgtgaacgggccgtaccacgagttccaagcggacaatcccgtgggtggccaagcggataatgttctcggtgtcttcagctgtcagggacgatgcgcctttcttcatccgggacttgaatatgccgttctgcttgcggtatgtagccagtgccgcgtccagatcatgctccggaatcgtccacgtcatgccccggtcgtatgtgccatgcggtttgcaagcacgcagtaccagcgtgcgggaaaccaggaaatcggtccggttgttcctcggaatgacgtgctccttgtagaggttgtcatcggccacctctatccatgtgcggtatgtgtcgatgcagaaaatcatctggcgatatatcgtgtttcgcataggaactgttttacatgaaatccaacagcacgtcttccagctccttcttgtacttgaagctgccgtttccggtgtggagtttcaagtcgagagacaggtcgccgtacatcagttccaacgaatcgtaaacggtcgcgatgacgcggtttaccttaccgtctgcgtctgtccgggcgttcatcttgaacatttgtccgaaagcgggattggagtaggcacaggtgctatgaccggatttttccaatccgaccggcacatggtggtagagcgtgatcagctccatgtcgtcctcgaatatgtccatgacctcctccaaatcataggggtcccgcaacgggaacgtgagcagaacgtagtcgccgtaaaactgcggttcctccattgtcgccacattgagaagctgcggcatttgcaggggtacgaacgacataaagtcatccaaaaagtgtcgtaacataatcatatatcgtttattttgtgaacaggcttttacaaagaggcgatgaatatctccatgagcataccgggcagctcgtccaaccggtttctttccgacggcaggattttacgcagtgtctcgaaagcgccgggtgtctcggtcgcaatccggtcgagggctttcttatcctccggagagagaagcgtcatacagaggccgtccaaggaagcgtagggctggagtatcatccaaatgtaggcgtgtgcctgttcgggtgttgcgacttcgccccgatgtatgtcgtcgagacaggtacgcacgttctgtatcagtcggcggtcggcacgcagggccatgtatatcagggcctccttgtaggtaatctctttgcgtccggcggcgagaaacacctcggaacagcacttctccgtgtcgcaggtaatgtcggccatgtttgcactgccggaatcgtgcagaccggacagaaaagcgcgaaaaacggcgtcttctttctcgatgaatctcttgaggtcacgactgtcgtgtatgccgtcgttcagggttccggcaagcaacttacgatatgccgacagcgtttgctccttgttgccacggtaggcaggccgtttatccagtgctgcgaaaaacggacggatctcctcggcggaacggtgcagttccacgtctccggcatagggagagaaccgctctttcaggctcaacacttccttgtaggtgcgcggtttcgacagggtcaaccgggaaagttccgagcaaatggaatcgtgtaacagacgacattcttcccgtgtgccggaatgggtctgacgggccgtgtcccgccgaatggctgcagccacggaatctttcaaggtttgccattccccgatacatacggtcagctcttcaaaggaaagttcttgggacttgcgtatctcggagaggtactctctgtacagaccggcaggcgtgtcttggggttccgccagtgatttgccgttcggaccgtcgcatgacgggaatgtgaaaacggcaattgaagcggcagaaagtccagcaatggaaagtatgatttttaagtatgattttctattattcattgttcaattttgaattttacagcgcaaatctaagtattattttcaagatggcaagtgttgaaatttgttttataagctatttttaacattgtacttaatagtttgattttcaatgaaaacaagtgaagaaaacgggaaaatccaagtgctttcttcgattttccactcaaagtatggtttagtttaaaataaaactgttatatttgtacttgttatcatagaagtgtacaattagatggcaaaagtaggttacatatttaaggcggatcgttacgacgggttcgaggctgacaaagaatggatgcaggagtacggctgtgtacaagtgatagaggaaccggtcgaaagcgaggcgctacggcctaaatggaaacagcttgtggcgggcctcgaaaggggcgacgaggtagtggtggccaaattcagcaatgccctccgagggtcgcgcgaactgtcggccttcattgagttgtgccgtatcaaggtggtacgcatcatatccatccatgaccggatcgactcacggggtaaactgtttcccgaaacgacggttgccgatgtgctggagatgttcggggcgcttcccgaagaggtggcgatactgcgatattcgtccgcacgtgtcttgaacctgcaacagaaagcgaagattccgaagaaaacgatgaaggctatggacaaggccgacaaggaaaatactatcgttgacatgtatgtcaacggccattcgtttgaggacatcatggcggtaagcgggtacagcagccgaagttcggtgttcagcgtgctccacaggcatggggtaaaactcaacagggggaaattcagcggccccttgggaacccggaaaaagaaaaaggacgacagtccggcggaagaataacccgtaaaacgaaaagggtggcggcaactaccgcttataaacggtttaactgtcggaaaacgaggttgaaacggattcgcactcttggtaacaaacagcagatgtttaatttattaatacagattaaataaaaacgtagtatggaagtaatattgataatcgttgtgttctgggtagtgggtaaacttctgaaagcggtgttcggcggttttagcaagagcgactaccggcgcgaccagtaacacgtatgagacaacgacggcattgtctcgccggttctttcgtgccaggagtcggaatatgattcgtataaatcaaaagatgaatgtagataaatgaaaacttaccttatcttgtttttggctatcgtttttgaaactgtagccacttctttcttgaaacagagcgaacagtttaccaaactcgttccgtccgtattgaccgttctggggtacgcggcggctttctattgcttgagtgtcgtactgaagagcattccggtaggcatagcttacgccatttggtcgggagtgggtatcattcttatcgcgcttatcggctttttcgttttcaaacagcacctcgacctggctgccatcatcgggctggtcctgattattgccggagtggtcgtcatcaatgtcttctccaactcggtctctcattgatggaagtgtcccgtcattgtgttctataccaaacgaaaagaaagaaatcatgtttttcatcagcatggtttctttcttttttcagcattataggaaggagtcaaatatatacattcaacataagatacaagtatgccttttcgtccttactgttatgatgttcaagttcgaattgtaccttatcttcacgggccaaccagccaatagcactacccaactcggcatcatccatccctgtaattttctttatctctgaaaattcccatttacggagatggtcactattcaataaacgccaaactttaccagcgttctcgccaatgatgtatttatccataaattataatatatttattgttatatgtatataatatgttatacaaatgtacagttttgataacgaattatcgtttatgttccattaatgtttattaatacatcatgcatttggcggaatttttattccagataactgctcagaatgccgctaccaatctttaaacttttttaacagcggcattttacatggaacctaaatccgaaaaaattgcctgcaaattatggcacgttgccgggaatatatccaaaatgtaacgacaatcactaaagtcgtcagaatttcagacaacggtaaggcgagccaaattccttttactcccattatggcaggtaataccatgaagcacggaaccagaaaaacaaatccacgtaagactgcaaatgttatggccggctttatccgttccatgctctgataatatccaataatggagagattcaaaataaagaagatgaatcccgtgccataataagggaatccttctatcgctatgcgtgcggcagtattgtcaatgcgcaagaatagtccgacaagcaattcaggaaacaggataaaggcggcagtagaaatgactccgcaaactaatgccgcaaacacggaaacgcgtaaggcggaacgaactctttccgtgcttcctgtgccgaaattgtaactgataataggctgggcagattgggcaatggcgttacctatcatgaagacgaacgggagataataacagcttactccgaaagcacctactccgtcatctcccaaatggcgcatgaatacctggttgccgatgaacagcaatatcgccattgtcaattcgcctaacaaggcggatgagcctatcttgcactgcattcctatatcatggaagaagaataaaatcctttttctacccggacggagagaatgcaaacgagtgtcacgggcatagaacaacaagtaacccatcgtcaccgttgccccggccaaacaactcagggaggtagcaaatgccgcccccatcactccccagcccagcgggaagatgaacagccagtcgagaacgacattcaccgctgcggctatgatgctgcaccacatggcgagtttcggagcgccgtccaggcgcatggcaaacaaggcgacggcaatccacaactcgaacagcagagacggggaaaaccagaccagataatcgacaaccagcggcagcaaatgctccgacgagccaagcatacgggcggtttcttcgggaaacgccagaatgaatcctccgacggttacggatatgagcgtcacgaaaagcatggcttgggtgatggtcgcacgtgccaaaacggtttttcctttcgacaagtaaatggaagcgattacggaacaacctgcccccatcatcagtccaacacccatgagtgacatcagtagagggacgcagatatttacagctgcaatcccgtcgctgcccacgccgtgtcccacgaaaatcccgtcgatagtcgttaccgccgacatactcaacattcccaacagagtggggaaaaacagtttcttaaacagaacggaaactctctcattcccaaaatcaatcactttttctttcatacgtctttgtattttatattatatggtttacttccggcagaaaacgacggaagccggataagacgatggttttacccagtcatcttatccggcttccatagccctccgatgaggattataaaatgtcctttgcgttatttcgccgcaaaggtgggccaaagatttgacttatccaaaaaaagttgcatttttgtacattgctatttaattcttatatatgacaaaagcagaaattgttagccggattgcacagcagaccggaatagagaaagaggtcgtaatgaccgtggtcgaggcattcatggagaatgtaaaagatgcgatgattgccgggaacgaagtgttcctgcggggtttcggtagcttcattatcaagcaaagggcagagaaggtggcccgtaacatatcaaagaacacaactattgtgattccagctcattccatccccgccttcaaaccggcaaaagtattcctgagtgccgtaaaagagggaaaataaaggacgtgtaaaagtttcattttattttgtagatttgtatctattagcgatttaagagggattaagtttttagtctaaaagataatacagaattgttatgattaaagaattgagagttggcaattacgttgcttataaaggtaaaccatctttggtttgtgcattggattatgatcctaagttgagaaaagagaatatatccgttgtttataaatggggagaacctccgtataaaacaaatggagacattcagccaatattacttactgaaaaattggttttgcaatgcggttttaatcagcttgacgattatacatttgacaatgatgaaatggagattacacaagactgggatgatcaaactgtatattacattaccactcatgctaatgaatatacggtaagcggacaccgcatagaatacttacaccagctccagaatgcgtatttttgtttatctggtggaaaagaattagaagttaacctataaagaaaagaggcttttagaactgcctctttttctttatatcatgcgagggtattatatatttaatccgtcacctcccagtaatagcttaactcgttccctttcagattctctttggcgtattggtcggcttgttcccaaagagtattgtaaagtaccgccatatccggtctgttttcatagtattgccatatcttatggttaagtaccaatgtcagttccgtcaagaacttatagtcccctttccactccctgaaagcccggttgaaagtgtccaaaacagccgccaacccaaatctgtccgctattgagaagtcttcccaaaaggttgtttgtaactcataaccgttctcttgcataaattctttaaatgtcatacgctctaaattttaagtttgaactattttttgtttttccctttggtacaatcctgtaccgaaaggttgattatttttctgcctataggattgacggtcggtccaggcaagaaggctgcgaaaaatacactctccaacaaagtcggggaggaagatttttcgacagcaagcgtaagcggttcttgacaggacagacaagcggcaatcgaactttgcagaaaaaataagcgggctttcggcatggagtgttgggaaacggctgtaaggaggataaaacgggggaagctaaaatgttataaaaggattactttccggctggatagtcacggtacaaaggggaacggaccgcgtttcgataaaagggaaagagccatgaagatataaagggggaattccggcaaaaggattcaggacacatccattgtcaatgtatcccgaacctgcaccggtcattatctgtaccgaatgtttaggaaacccatttgtaaccttcgtccgtcagttcaaaatattcgtccattcccggtttcacaaaaaacatgatttcaaaggcttcgttgcttctaccttcgggtatcgtcatgttgatttctccattgcgggctgttcctcttcccgtattgaaacctaagtcttcgtccgcataggcgtaatggaattccacatccggaaatatctcggaaagtttttggataagcagtggcactccattccatgccgtatcgaaccaaagtatgttcggctcttcaaagtcttggtgataggcattccattttgtaccccatgtggcggtagaccactcgtaccaagtgggataaccgtactttttccgattttccaaatacgatgctccaagttgcagcgcttcttttctgtccttttccgccaatccttctatccattgaatggttctcaaagcatcatcgtccaataaaaaatagaatggcttcaactgcattgcttcaaggtatttcatacccaaatctccactgctgcttttttctatcaacagttcttcaggcataggaatgatgttgttgaagtcgatgtaacaaggcgtattgtcatcatcggttttaccttttaagaaattcattactttttgtactgtttcccggtctgcgtttatttctaaacggtttgtcacatgattaggcataatcttagttttttgaaattgttaatacttattttcccttttgtcggttctttcttcctgaaccgctttggggttttacggatgcggtacacggctgtcgggaaaacttcatacggtggctttccttggaaaattactcttaccccggtaaggaagaattttgcaagaaatgcacttcaagccaccggatcaagtgcgacggcctacctttgcatctggtaaaaccaaaccggtgatggaaagaagaaaagacgggagatatacgaaagaccggggtcggtataaaaggcggatattgctccgtgagtagtgataaaaaggaatggagctgattataaaaggagacggttctgtgtttcgcccattcgataaaggataccgcaaccatctctggcggatgcgttgcggtattttgtggacagcattttatgcggccttgtccggcttgcgctgccttgttttccagccgtacacggcggctacatacggatagagggaacgtgttctccggcggaaaccttcttcgtcgatttcacggttgtaaatcttatcggcgatacgctccgcttcatcacggtctttggcgatacgatacaaggtgtagttcgtaccgtcatgatggcccatccgtccgcgaatgttatagccgtcgccgtaccattctgcatcgtcgcactgggatttcaaaatatcggcaatggtgctgcccaatatttgatagccttgtctccggccgttccataatcccaagttgccgaacacgacaataatgccgtccacttctttattcagattgctccgttcgtcgtccagccagcgatatacttcttctgcccattcttcatcgctgacctcgtaacagtcatcgtccaatatttcccgttgtgaattttgatagtattcttttgccgtttcgtccaacaggtcatagcttgaccaaatcatctgtttcatacgtcttgaattttaagtttgacttttgtttttttatccctgccttcggagggtttccctcgtccggcgggatttgattttacgtgcggaccacaaggcggacagaagggaaacaaggcaaggaggaagcggatagtcctatggacgatttcatttgtgttgaacaagtattgacgagcttgcgagttgatggttgttaacctcaaatgaagccgcgccttgccggttcccgaccgccttaactttgcacgggaaaatcaatggacgacggcggactcttcgtgtggagtatgaaggagtataaaagtatagacgttccggaacggtaacgagcaaaacaaaagcggccttcgggccgctttgtctcaaaaaggcaggaattacttcttgcccttcttcggtttctttgccggttccgcaggaacttcctcctctttatcgacagccggataaaatttgactgcaaccgtcacgatgcggttgtgcagcacgccgtctttgtcggtccattcttcgggtttaaaatagccctccacggtaagcagcgtgcccttggtgagctggtcgaacgacccggtattctcgttcttgcgccacgcttcaatgttcatgaaagcggatatacgcttggtatcttcgccgttcttctcctgacgggccactgccagcgggaaacgtgcgacacttgtggtggtgaactgacggacttcggcatcttttgccacgaatccggttactgcgaaattgttctcgatctttttcattgcgattgctttttgaagttaataaatcagttttacggtgcataaaagtaggtgcagtaaagggctgcaccaaggatagcgcataaatactctttattttggaggcgaagccccaaaccgcaggcccgataaaggaagatttgtgcgatacgccattggtcaagaccatcgggtcgcgcccgtctgcatactaactttgcaacgaaaaacgatatggcgacttcaaatagaaagcggtcgcgaaaaagtcgaggcgaaacaatccgcagcggactcggaaacatgaaagacctgtccgtccaccgacacaagaccgctcccgttccggcaggtgggcgggaagaacatcaggcgagaaagtgtatcggctgtttggggttgaagcggcaagaacgatataccgtttaacaaccatatacgctgcatcgtggaaaatactatcggacgaagatccggcaaaaggcgtgtgcgacgtatcgatatcgctgtctctatccggcaagagaaatgagggaaagaagaggtaaaggaaaaatggccgaagtctgccttgaaacaaagcggagaagccgcctttgcatgagtggccgttcgatataaaaggatatggcgcagccgaaatgtataaaggggtatttccgaaggaaacggtatgagtgtctgttcggaaataaaagagggtatcgcacccgcgtatctgttttagattttagccggtgtaaccgggctgaaactggtactccagcccgtactacatttaccttttttctgttttggtctgtaattctaccggctcgtcatcccatgtcagttctttgccgagaagtttgtaaacagtccctttggggagttctatctcgattggtacattgtacacttcttccaaatactcccaatgcccacaccggccccgaacgggcttttcgggcataatccattctgttccgtctttatttactgccaaccatgccataatatcacatttttagtctgttccttagtagtaattttattcttcttgagctatcattctcttactgtattccaaaattttatccatcgtaagccactccggtttttctccctccttgaagctatcatgcagttttatcataaactcaatttgcaatttttcgtcgccagcccataaggttttggggtgtctgttaccgtaattgaggtaatactcgcagtctgaccgtaagcggtctaacagttggtatctgaaaaccgaatccctgtgtattacttcgtctaccgttactcttccatttgaatttgttacatcgtttgtcataacctataaaattttgagttttctttttccctcttgtagcacctgctactttcgggcctgatttaattatgtcgcctcgaaaggtgtcatagctctttatgcaaggtttcacgattaaatactacccgtgcgaagcggagggtggagattttgtcgtgaaccgtcaggctttgaccttgcatacaagaacggcatgacaagtacctttgcgacacaatttatatcaggcagcccgaaagcgatgtgcgaacacagggaagagaaggtctcgtgtaaaaggttgatgggcgataaaaagggtttgcagcgaaaagagaaatataaacgggtattccggggcagtataaaaattgatcgtgaggataaaagggggattgtgccagcatgtctattgcgagaaagaggaacgggctgaagctggtagttccggttcagcccgcaaagcgcattggaggtcttttgcctgttcctgtcagaaatgggctaccataatccgatgtttgaaaatcctgtttttatcgctcggtcgccgttgctttatccagatatggtgtgctccgtatccgaatatgaaatagtcgtcgagcgtggtttcgttcttcaagcgttccatacttgcccgaagttcggtttcgtcagttgcaaaaagaatcgtgttcatgattcggaaatagatttcttccgcttcatcgctatagcggcaaaagacgtgttcgattgttacgttcatggttctattggtttgattgaggtgtttcgggtacattagtcattattgattctccgtcttgattgaaaatttctattgtcgggttgccgtcgttttcttcggggagcatagattccgatgtatcggtcaatgcttgccactcttcatagcaaagacggttgtcaatgatgttcgacacgtcctcacagttccatgagcggacgattgcctcggcttcttcataactgtccgctttcacactgaaataatcccgttcccaacttgtaaccttacggtcttgataaaatttgtattctcccatatccttgttgttttaaccgcttacttctacaatatcctctattctgccgtacagtatcgagcgtaacgctgttttgtcaatcgcataatactcgtgaatacttccgtgctgtttgacgaaataccgtttgaggatgtcggaaaagtcaaagtgataaccgctcaaggcaattccacgtttgaaatagatactttcccatacgttacgggtaatccagttcttttcttcccggtttaacttgcctccgttgttcaggtgtacccgcaatttgtaaaccttgctgtcctgcaatgtcgccagttcgggaatgtcccatttgacgaattttgttgctatctgtgtcatacgtttgctatcgtttaatcatggataatcacttcatcacggtattctgaaatttccttgccgctttcaaggcggacaactatggtattgccatagtcgcccacgattgtgccttccatgtaacctttatatggattgagcaacgtgcaggacaaaccgataatatcgctatcttcttcgtattcgtacatagtgaattgtgtttaggtttaggataacttaatgttccatttaccttgcgagaatatccgaaagctcacgtattcgtcctctaactcgtatgtcagtatgcggatatagattttgtctttggctgccaataaggctattaattcgttgattgctttttccgggtattcccagcgggaatcaaattcggcatctaccgtgtcgccataccggttgacaaagccgttgaaattatcgtccagaaatgcctctatcttattgaggtcttgtttgttttccgtacttgcgtggaaaatgtttgttgcgtagtttgccataactttgaattttaagttttcttttttccctcttgtagcatccagctactttcgggcttgatttaattatgtcgcttcaaaaggtgtcatggctctttatgcaaggtttcacgattaaatactacccgtgcggaacggagggtggagattttgtcgtgaaccgttaggctttgaccttgcatacaagaaagacatgacaagtacctttgcgacacaattcatatcaggcagcccgaaagcggatgtgcgaacacagggaagagaagatctcgtgtaaaaggttgatggtttataaaaagggggttgcagcgaaaagaaaaatatgacgtggaatgtttttttcttttggctgtacaatgggaccggagtgttttacgaagttcgggaaaaggtttagtttagtccattagcctatatatatgctaaatcaaagtaaactatatttaggcagccaaatttgcctgcctataagtttttccttatctttgtatgaactaaagaatacttgcttttttcttttggctgcagtggttcttggaagctcacatgcaaccatcggacgaaaaaaatctggtgggaagctgttcaagaagtcccgattataagcaagtgcaaagaaagaaacagagtgaaaacaaaaaattgggaaatacctttaattaacgattttgtttcttgtttgttccttaattaaaatcgtgaaattttcaacaatctgattttcaaatcattatataaactatttttgagagattgaatttattaacaataaaagaagattaaatgttagatctttgtcttattcttcagttttatttgtcgctttttttgtattgctgatcttaacgacaggtagtagaacagttcctttgcagatagtattaatttttttaggattgtatacttatttatataagaatctgaaagtacttccaacatttatctatctgttgctaggaggattgttgatgttctcaattatgataataagatcttctgatgcagtacaaataaatagttttgcagatattgttatggatttagttgtaaataaccgtaattcgtttatcgctgttgattatgttgatgaaaaagggatatcatatggtgtttcaatgttatcaaatatactggctccaattccttttctacagcagattatatataatttatttgatataaatccagatgttggggcctcttctataattattacgagattaactcttggtagctcagattctaaattagggttggggactaatataattgccgatatatatatggcttttggtctatggggggttatgattatgatgtttggcttagggtattttattagttatttattagtgatggctaaaagaaatgtttatgcattaacttcatatgccattatgatttcttatgctgtttttttagtgagagcagaatattttttctttttgcgggcattaacttggtgtttggtgataataaacataacaagaaatcatcctattaatatcgtttaccaattgaaaaagtaaaaatgaatgtgttaataatttgtagtaatatcacaccaaatgggggaactgagagagctgtatcaaatttagtagatatgcttagtgatgaagatggtatgaatgttgcaattatcagtttaataagtaaaccaggagataaaagctatttctcaatagatggagctaagatttatcatttggctcaaaaacctttgaaatctaagttttttagtaaactattttggtatattaatgtgattgataagttatcaaagtttataattaaaaatgatattaaggcagatgtaattttgggtataggccacaatataaacgtaatattacctttttttaaaaaaaaaggtatgagaatatttggttgtgaacatattgcttttaatactattccttcaatatttaggtggattcttaagataatgtatccttttttggatggaatagttgttttatcttctactgctaaaaataaagtttctacttataataaaaaaattgtggttattcctaattctcttccatttattgcaccacatatggctcagttaaaagagttgagaattataatggttggaagattaagcaaggaaaaaggatacgaacgtttaattcccattgctaaatctttacagaaaaaacatgttaattggcacattgatatatacggtaatggtgagcaatttgaactgttgagtaatttgtttgcagaaaataaagtaaatgaatttgtaaggttgcgtggtagtattaaaaatgttgtagaggaatatttaacaagttctattttgattatgacatcctataccgaagcttttccaatggtattattagaagcaaagtcatgtggcttacctgttatagcatatgagtgcgaagggacaaatgaattaattagaaatggtattgatggatatataatacctaataataactatattgaattcgtaaataagacttctgaattaatggaaagttacgaaaggcggcttaatatgggaaatcaagcatttgttgatgtgttaaaatataaaaaagaatttataagcaagcaatggagcgagcttttgagaggataatagtatttattgttgttgtatttattgaggagatcatcttgctttctcttttataggcttataagttatacattaaaatagtatatgtcgttttatgaatatttagtaacacaaatcatctttgatataaaaatgcaaaacaattaattcatttaattgcgttaaggtttatggataattaattacttattgtttaagatataaaagaatgatattgacaatatgatgaaatgtattttagataatataatattctctttgcaaagagcgggaggggcttctgtagtatggcaagaacatattaatcggttgctgttagaggaaaatattgatttacgatttattgagtatagtaatgctaatacaaatatttttagaaagaaacttgaaatttcaacagataaaatattgaaacaaggagcagcatttttatttttgaaaagatatattgatttgtatggatctggagaggaacgatatatttttcattcttctcattatagattagatactaatcataatgcgttgaatgtaacaactgttcatgattttacatatgagtatttcgtgccaggttttcgaaagtttgttcattctttacaaaaatggcggtcaatacggaaatgcgctgctgtaatttgtattacagaaagtacaaagcgggatcttttaacgtttttgccagatatagatgaatcaaaaattagtgttattcataatggggttagtgaacaatttagagttctgactcaaaatgaatatgagttgagattgccttttgatgattatgactatattttgtatgttggaagtcgtttagtaccatataagaactttgatattgttcttgatgtatgtgcgcatctccatatgccattattaatggtaggtggtgaacctttatctagagaagaaaagaatcgaattgataaaaagttggggcagaatcgttattttaattattggggaactactatttctcaccttaacgaactatataatagagcattcgtacttttatatccatcgttgtatgagggttttgggatacctattattgaggctcaaagagcaggatgtcctgttattacatccactaactcgtcgattccggaagtaatgggtgattccaaatattcattagtagatatttctgtaaattcaatagttagtgctatttcatttcttaacaatagatcaaatgaacgtgaaaacgaaataaagagggggatggaaaattctttgcgtttttcatgggataaaacctataatgaaacaatacaagtctataataatctttataaatcctgatgtttttatttaagagctattattctataagcaatattttctaccttatttattgcttatttagaacaaaactgttattccccaatgcaagattgattcgctttccatttgatatcagaaataaagattttatttctatagggaaggggtttacaagtggacctggttgccgattggagtgtggtggatattttattgataaggcacctaagttgtttataggaaaaaatgttcaaattaacgattatgtacatatttccgcatgggaaaatgtctctatcggtaataatgttttattggcaagcaaaatatatatatctgacgtctctcatggtacatttaagtctcatatagaatatgatattactcttcctccttcagaacagccgcttgttactagtcctgtgaatattggagataatacttggattggagaaatggtaactgttttacctggttctcacattggaaaatgttgtattataggggctaattcattggttaatagggatataccggattatagcatagcggtcggaaatccggttcgtatagtgaagcgttattgctttgaaactcgcacatggcgtaaagtgaattttgacggacaattcatcgaataataataatttataataatgaaacatatacttattactggtggggctggttttatcggttctaatctaacactgaaacttattgaaaaaggatattatgttacaatattggataacctaagtcctcaaattcatggagataatccagatcaaacatctcctctttataattcggttaaaaataaggttcgattcataaaaggaaatgtaacatctcgtgaagattggctagaagcattaaaagggcaggaatgtgtggttcatttggccgcggaaacaggaacgggacagtctatgtatgagatacaaaaatatgttgatgttaatattggggggacagctctattgcttgatatcctaactaacatggaacattcgattaggaaggtgattgttgcagaatctagagctatttacggtgaaggtcgttattatagtgacgatttaaaacaatatgtttatccaaaagaaaggcaggaagaagatatgaatagtggggattttgaggtgaaatacccaggttgtcgattccccttaaaattagttggtactactgaagattctttagttcatccaacttctgtatatgggataactaaacaagtgcagggacaattagtacatttggtttgtgcttctattggcattgcttcagtttcatatcgttatcaaaatgtatatggtcctggtcaatctttgtctaatccatatactggtatattgtctattttttctactcaaataaagaatgggaattctattaatatatttgaagatggaaaggaaagtcgtgattttgtgtatattgatgatgttgtagatgctactattcttggcatagaaagggaagaagcaaatggacaggtatttaatgttggcactggtatagcaatagatgttgtaacggtgactaacgaattaatgaacaattatggaattagagtacctgtaaatatttcaggaaattaccgattgggagatattcgacacaactacgctgatattactaagattgaaactttgttaggtttcaagcctaaagtttctttttcagaaggaattaaaaaatttacaacttgggttaacaaacaacaaattcaggttgatagatatagtgaatctatcaaagagatgaaagaaaaaggactctataaatgaattatttagaaaataagtctgttttattgatttcgccttcattctttggttatgagcaatctataaaacagcgtttgtccgaaatatctgcaagagttgattattttgatgaacgtcctgctaatactttttggagtaaagccttggttcgtattgatcgtcgttttttatctcatcatatttctcaatattatgaatcaatttatcagattatccagaatcgcatttatgattatgtatttgtggtgaatatagaggcaatgcctatctcttttttggaaagagtcagaaaaattaacccacaagctgtatttattctatatatgtgggattctatatcaaataagagaaatactgttaattatttatcgttatttgatcgtattttttcttttgatcgtgatgactgtaaaatatatgctaatattcgttttagacctttgttctttttaaatgagtataaagagcttgctaatgtaagtgattatgaatatgatttttcctttgtaggtaccgctcatagtgatagatatgctcttattcgaaaaatatatgttcaaatatgtaacttgtgtatgaaatcctattggcatttgtatttacaagataaaaaattgttctattggaataaaattactaattcagcttttttaaaggcacatctacatgactttcaatatagagctttattgaagagtgaagtgttagacttggtgaagaagagccgaattattattgatattcagcatcctcgacaagtagggttgactatgcggactatcgaaatcttaggagctagaaggaagttaatcacaactaatgcttcaattaaagattatgacttttatttagatgacaatatattagttatagacagagaaaatcctataataaatcgggagttttgttttaaagattataaaccgttagatgaccatatttactataagtattctttggatggttggttagaagaaatattccagtaaacatgaaaggcattgtattagctggtggtagtggtactcgtttgtatcctattactaaaggagtgagtaaacaactcctcccgatttttgataaacctatgatttattatccaatttctatcttgatgttggctggtattcgcaagattttgataatatctactccatatgaccttcctggttttcagcgtttgttaggtgatggctcagattatggtatacaccttgaatatgcagaacagccttcaccggatggattagcgcaggcatttctgattggtgaaaaatttataggtagtgattcggtgtgtttagttcttggcgataatatcttttatgggcagagttttacccggatgttaagagaggctgtttgtactgctgaagaagaaaataaggccacaatatttgggtattgggttactgacccagagcgttatggagtggcggaatttgataaagaaggaaatgtgcttagtatagaagagaaacctgaaatcccaaaatcaaactatgcagtggttgggctttacttttatcccagtcgtgtagtagaagtagcaaagaatataaagccttctgctcgtggggagttagaaataactacagtaaatcaagagtttttgcaggcacaagaactgaaggtacaattattgggacgtggctttgcttggttggatactggaactcatgattcgttgagtgaagcatctaattttatagaagtaatagagaagcgacaaggtttgaaggtagcttgcttggaaggtattgctttgaggcaaggctggattacttctgataaaatgcgtgagctagctcagccaatgctgaagaatcagtatggtcaatacttactgaaagtaattgaagaactgaaaatgaaataaagtaatggaaattataaagactaatatagaaggagtcgttattatcgaaccccgtatttttaaagacgatcgtggttatttctttgaatctttttctcaaagagaatttgaggaaaaggtttgtaaaacgacctttgttcaagataatgaaagtaagtctagctatggagtattgagaggcttacatttccagaaacctccttttgctcaaagtaaattagtgcgagttataaaaggagttgtgttagatgttgctgttgatataagaaaaggctctcctacatttgggcaatatgtatctgtagaattaacaggtgaaaatcatcgtcagttttttatacctcgtggatttgctcatggatttagtgttttaagtgaagaagtgattttccaatataaatgtgataacttctattctcctcaaagtgaaggagcaatagcatggaatgatccggatttgaatattgattggcgtattcctgctgaaaaagtggttctctcagagaaagacagtaagcatccaaggttaaaagattggcagaatgtgttttaggatattactccaattacctgcaattcagttcttagaattgaaataaacgacgattgggagcatattcttgaacgaatgcaccgataaaaagaaaaaaacattgagaagattgtattgaatcttctcaatgtttgaatccaatcattaagaagattttttcaaacttcccaatgatttttgtaagctttcaaagtgacataatgacaaaaaggacatatggcctcttttataaattcttatgatgcgttctttaaactactttgctgatttttaatttattgattgccttttatggactgtttttatgtgattgccgaaatcgtattttacgcgagctagattgttgctttgttgatgaacgcttccggtagcttatcaataaagtgttggatattgtacggattatttaaaggataaagtgtgggagatagcattaaggacaataataactggttatgctcataacaacaggaaatcaggcagatatttgtacacgattttaggaaaacatgacctttgctttctgttttttaccttgctgatccgcttctttttccttattgccatcttcaaaactatcatgtgcctttttgtccttttgtctttttgagagagaaggataaagcgaagtgtcgaatgcggatgagtgcatgcaactttttgtaaaccagattataacatgctatttatttctcggatagggaaaacggaatcctcaaaataggttgtaatatcgcgtaatatgcttttgggggaatatttttgtggcaggcttcgcaagcgaggagatttcattgatcaacagtttatttgtttaagaaaatgtgctacaaaaaaaactagctggtttcttttttgctttctattcttgataggagaggtaattttttgacataaaagctttctttatttaatttattttatatctttgctagcatatcaagattacaatcaactatttattcacataaacttaataaaattatgttcaaagctcctttttcttttgacggtcgtattcgtaggatcgaatatttcctgtctggtattatcggtggtatcgtttttggtgttgcctattctctcggtttagctactttgtttcttggtgcggctgccggttccgcgggtggttccctgtttggtatcttgattggtatcgtagcgggaatagcttccatatggttctctttggcgcagggcgtgaagcggttgcatgacttgaataagtccggttggttgatactcatttgctgtgttcctatcatcggatgggtgttcagtctctatatgttgtttgctgatggtacggtaggtcctaatcagtatggtgaagatccgaagaaccgtatgccatatcagccgcagccaacttctgtaaatgtaacagtgaatgtgtcgagagaaactcctgctgaagaagaaaaaacagaaaaagccgaatagtctttaataagcagaaatatggttgcctcttgcaaaattcgttttgcgagaggcatttttttactacctttgagaattggtaaacaaaaaaagaagataaatatgaaaaaagtaatttgcagtgaaaaagcaccgggagctatcggaccttatagtcaggcgatagaagccagtggaatggtattcgtatccggtcagttgcctatcgatgcggctaccggaaagatggcggaaggaattgaagagcaggcacgtcagtcgttggagaatataaaacacatcctggaagaaacaggtttgacaatgggaaacattgtaaaaacgactgtattccttcaggatatgtctttctttgccggaatgaacggcgtatatgctacgtattttgacggagcttttccggcacgttcggcggtagccgtaaaggctttgccgaaggatgcgttagtggagattgagtgtatcgcggttcgctaacaaatcggcgacaataaaactgctgcctcccacgaagatgaagtctttaggggggcagttttcttttgctgcccgcacggcatccactacggtagggtaggaagtgcctttcagtcccgcttccgaagccattttcatcagttcatcttccggcatcgcacgtttcacgctggctttggtgaaatagtaggtggcgtctttcggcaacagttccagaacgctgctgatatccttgtcgctgaccatgccgaatacaatatgcaattcttgatttaacttttcgtgtatgtacttaaattgcttacgaatacttttaaagccatcagcgttgtgacctgtgtcacagatgaggtcaggataactttggagcttctgccagcgtcccatcagaccggtcatttcgcatacatcagagaatccggtaaggtaatcgattttactgatttcatatccactgttttttaatatttccagagctgccaagatcgtgaggcaattttctgtctggtagagaccgcttaattcatagaacagtcccgtcataaaatcagagtttgtaatagctatcgcatcctttcttctgtcaatgactctgtcgatggcatgtatcgtatcagccgggttgataaaagagagaacttgcatcattctcatcgggagctgctgtatttgttgaagttttcgctcctcttctaataaaaggtccaatttttctctgcataccttcaattcgttgtgtggcatatatcttgtagctgtaaaccttttaaattcttccgagaaggtgatgaaagtattcatttgcttggctttcatcgtaaatacccttttcactgctccggatacttttcccactactaccggaatgccttctttgatgattcccgccttttctttggctattttagtcagtgtgtggcctagatattgcatatggtcgaaaccgatattggtaatgacactcagatcgggggtgatgatattggtgcagtccagacgtccgcccatgcctacctcgatcactgccacatctaccttctgatcggcaaaatagcgaaatgccattgctgtggtgagttcgaagaaagaagggtgcagaggttcgaaaaaggaacggtgatcttctacaaagttgaccacatactcttcgggaatcatttcaccgttgatacggatacgctcgcggaaatcaatcagatgcggggaagtgaataatccgactttatagcccgcagcttgtaggacggcagcgatcgtatgcgaacaggagccttttccatttgttccggcaatgtgtatcgttctgaattcttgatgcggatgaccgaaatgttcgtccaatttgtgtgttgtctctaaacctggcttatatgctttgccacctatttgctgaaacataggtacactttcatataagtactttaaagtgttctgataatccatgttttataatatttaactccgggcaatctttattgctcgcaaaattgtttatctttagaaccatcattccaactgcaaacgaaggattgatgaatgagactgcaaatatcaacattaaaatctaagaaatcatgggaactaagaaaaattttgtaattgacacaaatgttattcttcacgactacaattgcttgaagaattttcaggaaaatgatatttatctcccccttgtcgtactggaagaactggacaagttcaagaaaggaaacgagcagattaatttcaatgcccgtgagtttgtccgggaattggatttgctgacgagtgacgaacttttctccaaaggggtgagtctgggtgaagggatgggacgtctgttcgttgttcccggcaatgtggatgctcccaaagtccatgaatcttttccggtgaagaaacccgatcatctgatattggcagctgttgaatatctggcgaccaagcatccgaaaactccggctatcttagtgaccaaggatgtgaacctgcgtatgaaggcacgctccatcggtattatcagtgaagactatatcacagataaagtatcgaatgtcgatatatttgagaaatccaatgagatctttgaaaatgtagatccggcattaatcgaccgtatctattcctctaaagaaggcatcgacctgagtgaatttgactttaaagatgtcattcatcctaacgaatgcttcgtcttgaagagtgaccggaacagtgtactggcacgttataatccttttactcattccatttgccgcgtcacgaagggacgtaactatggcattgaacctcgcaatgccgaacagagttttgctttcgagatactgaacgatccgaacgtcaaactggtggcattgacaggaaaggcaggaacgggtaagacattgctggctttagcggcagctttaggtaagttgactgattataagcaagtattgctggcacgtccggtggtggcgttgtccaacaaagatatcggtttccttccgggagatgcacaggaaaaagttgctccatatatgcaaccgctgtttgacaatctgaatgtgatcaaacgtcagtttgccgctaactcgaccgaagtgaaacgtatcgaagatatgcagaagagcgagcaactggtgattgaagcgctggcatttatccgcgggcgtagtttgagtgaaatgtactgtatcattgacgaagcgcagaacctgactccaaatgaaataaaaacgattattacccgtgcgggcgaaggcacgaagatggtgtttacgggagatatccagcagattgaccagccgtatctggatagtcagtctaatggtcttgtatatatgatcgaccgtatgaaagaccagaatatctttgcacatgtcaatctggtgaaaggcgaacgcagtcagttgagtgagttggccagtaatctgttataaataataaagaactaaaaaaaagaagaatgaagaattaccggtagtataaatgcgccggcagattcttcattcttcttttttattctttgtttctagttcttcattcttaattttctttcttaccgaaatatttaaggaattgtgtacgttcgaacgtattgatgccttgaacgtctttaatattcagttttcctttgaactgagcgatgctttcgaaacctttccgttccatccatgcagataagaagcgggtggattctccgatgaatgcgttcgtgttctgatagacagcgctgcaaacttctacagcagtagctccggcaaggattgcttttactactgcttccggactggcaacaccgccggaggctgcataatcgattttgtctaccactgaggatgcgattccaatccagcggagaggagtggcaagatcggcggaagtgctgaatactgcaccggatatttgttccatattctcaatattgatatccggctggtagaaacggttgaaaagaaccaccgcagctgctccgttagcgtacagctgatcgatcagagctacgggatttgtcagattgtcccccagtttcataatcaccggaatgcttaccgtccgtttgatatgacgcaggatgtcgatatgacgctgctcaaatgaaccgtacgtatattgtacatccgattgcaatgccagaatattgatttccagtgcatcggcaccggcttcctgtatctgtttggcaaagtctatccattccgcatccgaatagcagttgatgctggctatgatggggatgttacactcttttttgctttccttgattaaggtgagatattcagctaatttatgttcacggatatattcttccagataatcgcttgcttccggataaaaagcgggatctttcagttgatccgcttccagcatgatttgctcctcaaacagagatttcagtacgatggcacctgcacctgcttctgccagtctcttatttttgccggcactgttggtcagtcccgagctactgataatgattgggtttctgagagaaagccctgcgaaagtagtttttaaatcggtcataattatatctttttaaagtagttggctactgattaatagtttctttctccgaatatcttgcttcctacccgtaccagagtgcttcctgcggcgattgcttcgtgatagtcatgtgacatacccatcgacaattcgcggaaagtaaaggtttcggcaaaccagtttgcttttatttcctgaaagagcctattcagtaaacaaaattcccggttaatttgttcaacatcatcggtgttgcttgccattcccatcaatccgcagatgcgtacgtgagacagttctttccattcgccggcatgcagcatatccttgcattcttcggggctgaaaccgaatttggtctcttcctgtgcaacgtgaatctgtaacagacagttcacgatacgtcccgctttggcagcttgcttgttgacttccgtcagcagtttgtacgtatcgattccatgtatcatcgctacgtaggggatcatgtatttgatcttgtttgtctgcaagtgcccgataaaatgccattcgatgtctttcggcaacgtttcgtatttagctgtcatttcctgcactttgctttctccgaaaatacgctgtcccgcctgataagcctcttctatcgcttcattgggatggaattttgagacagcaaccagccggactccttgtgggagttcggccagcacttgcttaagattgtcagcaatactcatggttacttatgcttttgacggatcaaactccggtttgtcattcggtccggcactgtaaggatatacatccatcaacggggtctcggataccataccgatctggtagtcggccatcgttcctttcatgccttcatccagcttcttcactgcgtcgcgcaagtcggcagcctgaaccagcacttgggtagaagtctttttctctgcaccgcttttttcgtcaagggtgataaagatcagtttgcacttaaaccagcggtcggcactttcctcgtcgctggggaaaagttcgctatagttggcacgtttaatgtccgatactgtaaattctcctgttataaatggagtcatctcctcgataatacgtgcttctgcttctgtaaagctgagtgcatctaccagataaggttccgtcactttcttctgcattccgttttccattgttttctcgtaacggattttgcactcaaaccaagtatgcattgccataatttttcttcttttttagtttattgattcgtgtaaattgcctacaaagataaacaaaatacgaagtaactgccgaaagatttttattttcttttatgcagattcttcaattcgaatgaaagcatgacgcggaaaagtccgatgatgaagaaagtaaaggaaatcatgtagaccacgtacaatgcacctactgccggttgccacaatatgatgagagcacagatgatggcgaggatgccgaaggccatataccagccccagtcacgggtgccgtaacgtttgaggtcgatggaatagccagtagaggagaagcctcggaacataagccagaaggcgatgataaacggaatcacttccatgctgaccatcggataggcaatcaggtaaatacctaagataaggtcgataattcctcctaccagataccagccccaactcggtacccccttgcggttgctgagggagaatataatttcgagaataccgcttatcagcatcgatatgctgaaaacgatgctaagtgccacatagctgctgaggggtgagaacataagccaaagggcgacaataatatacacgattcctaacaggagagaggtccaccagttttttactgaatgtttgatctcattgaaaacagtttccatacgttctttaattttaaatgaatactctgtgaatttgtggaggaataacaaattgattttagaaaaggttttcgtgtgaacatattccggggataagttgtttttattataaagtaattttaaaatgtaaatgcaatatggcaacaacaaatttcaaaggacaaccggtgaaactgatcggtgaatttatacaagtaggtaaagtcgctcctgactttgagttagtaaaaacagatttgtcttctttctccctgaaagacctgaacggcaaaaatgtgattctaaatatttttccaagcctggataccagtgtctgtgcaacatcggtacgcaaatttaataaaatgggagcaggtttgaaagatacggtggtactggctatctccaaagaccttccttttgcccatgcacgtttctgtacgacggaaggcattgaaaacgtaattccattgtcagatttccgtttctctgattttgacgagagctacggattgcgtatggcagacggaccgttggcaggcttactagcacgtgcagtagtcgtaatcggcaaagacggcaaagtagcatatacggaacttgttccggagattactcaggaacctgactatgagaaggcattggcggcagttaaagaataagtaatagggaataagtattaagtaataagtattagccgaagtcgcttatttcattattggcattaattatgcggagtattacttattacttaatacctattacttaatatctattacctattactttacattaaaccttaaccacatggacaaaattcgatttttcttcatcgccctgttaggtatgggcgctgcacacttgtcggctcaaacggccgatagtacacaaacttctccctggacaacggaaggtttcgccggactcaaactgacgcaggttagtttgactaactggtctgccggaggtgataactccgtcgcttttgacttgcaaggtacttatcaagctaactataaaaaaggaaagcatatatggaacaaccgtcttgaactggcttatggcttgaataagacaggtgaggacggcatgagaaaggccaatgataaaatatatatgaataccaactatgggtattctatcgccaaaaactggtatgcaagtgcatttaccactttccagacacaattctcgcccggatacgactattcagtcaataaggatgtcgctatctccgaatttatgtctccggcatatctgactaccggtttgggattcacatatgatccgggaaagattttcacggttgtattgtcccctgcctcctggcgcggcacctttgttctaaatgaccgtttgtctgatgaaggcgcatttggcgtcgatcccggcaagcatcttttgtcaagcttcggtgctaatctgaaaggagaggtgaaatatgaattcttaaagaacatgactgtatattcccgtctggacttgtactctgactacttacataaacctcagaatattgatgtgaactgggaagtgcagattaatatggcaatcaacaaatggttctccactacgctgaccaccaatatggtctatgacgatgatatcaaaatagttcagaaagacggcagcaaaggatcacgcctgcaatttaaagaagtgctgggcgtaggagtgcagtttaatttttaagtaataagtaataggtaataagtattaggtaataagtattaagtattaaaccgtgcggataagctaataacacagcagcttcggttaatacctaatacttattacctattacttattatttatttctcttcattcctttataaaccaggaagcccacgatgaatattccgattgcgatgaagcaatagccgatttcgtggctgtattcagttactttggcaatcagttgttcttcgctttcgatgccgggcactgtcgagaggtaataaccgattacggcgaggattgtattccataatccggctccgatagtggtgtacaacaggaaggtgtgcattttcatgcgggcaagtcctgccggtatggaaatcagctggcgaactgccggaatcaatcggccgatgaaggtggaaagtgcgccatgcttgtcgaaataagattcggcatgttgtactttggcttcgtcgatcagacacatatgaccaatacggctgttggcaaatttataaatgatgggacgtcccagccatttggccagataatagttgattaatgcaccgatatctgcaccgatggtggcaaataagactaccaagtaaatattaagctcgtcattgacagctgctttgtatgctgccggtgggatgatcacttccgatgggaaagggatgaaggagctttctatagtcattaataaagtgattgtccaataattcagatgttcgagacaccactggataaaagctactgattccatgtgtttttgggctaaagtttattaatatgattatttatttcctttctctttcttcatgcgcttccagacttctttgagcatttgttcgccttcctccgtttggttaggtctggacagcagatccagaatgatgtcctcgctgatcggatgggcactttcactgttgtacttgaagaagtcgtctatctcgttatgcatcagactgagaatactcagtttctctgtgacgtctgcatagttgggatcaatccggtatgactcttcaaaacagagtttggcttgatataagtactctgcgtccgaataggcagaagctaccaaataccacatttctgcactcggttccatcaccagtgctttgtcaaaggccttgaccgccttttttttctgaccttccttcatgtagagtttgccttctgtcagatggataccgggatcatccggctggatctttttggcttttttacatagcagatgcgcttcctcatgcttgcctagttgggaggcggctacagctttgttggtataagtatctatcaataaaggagagttgccggctccgtctgctacaaaacggtcgatgacacgttggtagcaatcgtctgcttcttgccatgctcctttgttggaatatgccatccccaaaaacatgtaacccatttcgggaggaaaggctttgtattctatcgcctttgtataattctcaatggcagcatccgaattgttcagatagaaatagcaatgtccgcggtaagcgtaggcttctccaaacgtctcgtcggcagccagtgcaaagtcacaggcttcgattgctttttcgctgtcttcagctgcaaagcggcatttggcaagtcccacccagtaactggcattgtaggggtccatatcaatcagttgattgtaataggtcgatgcggcttcgagttcattggtgcctgcgagatagtctgccatgacagctatgaaatcttcttttttaccgaatcggggggtacctttatccaaccattccttggcggcttcggggtatcccatatccatatagagatagatgatgttgatgattgtttccagttcatccgtatcttctatggtatccaatgtgcttcgggctgcttccagttgtccttcgttcagcagaagttccgctttcagcatttttacatcagtaatataatcatctgtgatgctttctgcaacttttttcgccagaggtattttaccggtatcaagataaagataggcctgttctaccagtagatctgtgctgtcgggatgcaggtggaggccgtaagttatgacctcttgcgcttcgtcgaatttccgttcggcagcgtatcggtcagcaatgtcggctagttggtctccgtccagatagagttgtcggttttctgcttttgccgtttcatattgagcgattaactcgtttagttctttatttgcggacggtgaattttttctccccattctgatttattttgatttgaataaagcagcgctaaaaagatgtttaggcacggattacacagattgaagcggcttgtaagttacgtgaactctttaaatccgtgcaatccgtgtaatccgtgcctgaataatatcatagatttattccttattcggcttttggcactgcctttttatgtttaagtagcctgtgaaggctgaattttatttattgattttgccccaggtatcctttaatcctaccgtgcggttgaatacaagtttctccggagtcgagtctttgtcgatattgaaataaccgatacgttggaattgcaggtatgagagcacaggcaaggttgccgcaaacttctcgatatagcaattcggcagaactttcaaagaatccggattgatgatttccttcattgcttccagagcttcgcagttcttggcttcacggatggcagccagttcgtcgcgtgggttttctactttccacagacggtcgtagagacgtacttctgcttgcaggcagtggttgcagctcacccagtggagcgtacctttcaccttgcggttggcatccggcataccgctgcgggtgttcgcgtcatattcacaatatacttctgtgattacgccgttctcatccttcttgcatccggtacattttacgatgtaagcgtttttgagacgtacttcctgtcccggagtcatgcggaaatatttcttgggcgcgtcttccataaagtcttcgcgttccatccataattcacggctgaactcaatcatgtggcttcctgcttccggatcttccggattgttgatagcttccagttcctccacttgtccttccggatagttggtgatgatgagtttcaccgggttgatgacagcagatacgcgggtagcacggctgttcagatcgtcgcgtacggagctttccagcaatgcgatatcgttcagggcatcgtaagtcgtataaccgattttatcgataaatttatgaatcgattccggagaataaccgcgacggcggaaaccgcagatggtcggcatacggggatcgtcccatccgttcaccagtccttcttttaccagcgtcagcaggttgcgtttgctcatcagcgtgtagctcaggttcagcttgttgaactcagtctgacggggacggttgtcgttcagatccttaccttctttcagccagtcgatgaagagatcatagagcggacggtgtaccacaaattcgagcgtacacagagagtgggttactccttcgaagaagtcactctgtccgtgggcgaagtcgtacatcggataagccttccaggtagtacctgtgcggtggtgaggatgcttcacgacacgatagatgatcgggtcgcggaaatgcatattaggattggccatgtcgattttggcacggagcaccatagcgccttcttctatctcaccgctgttcatcttcttgaagagttccaggctttcttcgattgggcggtcacggtacgggctgttcacacctgcttgcgtgggagtacctttttgctgggcaatctgttcggcagtttgctcgtcgatatatgcttttccttcctcaatgaggcggatggcgaagtcccataattgctggaaatagtcggaagcgtagtattcgtttccccattggtagccaagccattgaatatcttctttgatggcttctacgtattccacgtcctctttggtcgggtttgtgtcgtcgaaacgaaggttacatacaccgccatgtctggcagcgatgccgaaatcaaggcaaatagctttggcatgaccgatgtgaaggtatccgttcggttcgggcgggaagcgggtctgcacttttccaccatttttaccttccttcaaatccttctctactgcctgttcaataaagttcaggcttttcttatcgcctgtgtcttcgtttttaatatctgtcataacgttaaaatgttaactctatttataggctacaaaagtaggacattttttttattttactggaatataaccgctcttttttataatctcctgtccttcgggcgaaagaatgaagttgatcagaggagctacctgctctttgttcttcacattataatagtaataaagggggcggacaatgggataagtcttgttcgttgtgttctccactgtcggggcggcgtagtgacttccgtcatacgaaacggaaagcgttttggtgcggggagatacgtatgccagcccgacgtacccgatggctcccttcgtctgactgacggactggatgatagcacccgtggcgggcatggaaaggctgcctgccatatagttcttgtttttcagcacgttctccttgaagaattcgtaagttcccgaagaggtttcgcgggagtagacaactattttgcggtcgtctccgcccacttgcttccagttggtgatttttccgcggaagatgtcttccagctgctggcgggtgagctgtttcaccggattggaagggtgcaccactacggcaagggcgtcgtaggctacgatcacctcgtccacctcttgtccggcttctttggttttcatcttttcgctgaatttgatcggacgggaagccatggcaatatccgtcgtattatccatcagtgcagagatgccgaccccggtgcctcctccggtgacagtgacccgcgcatccggatgctgattcataaatcgctctgctgtttgttgggcaacaggcaatacggtgtcgctgcctttgatgcgctgtgcgttggcgctgagagacagaagggaaagggcgattaataaatttcttctcactttcataattattctttttattgttggtgcaaataaaacaatcacatattacatttttgtttcagataagggagaaataatgtttgtaacacaaatgtaacagcattgaaatacttccttcaaacgttagtcacacctccttaataaggagttgctttctttgcatcagaaaaccaataggtatgaagaagatttttgagaaaataatagaaggaattctgacttgtagcggtttcgtaacaagtattacaatcctgctgatcgtgcttttcctgtttacggaggctttcgggctgttcaatagcaaggtgattgaagaagggtacgtgctggctttgaacaaaggcaataaggtaaatacgctgagccctgctcagataaaggacgttttcgacgaggagataacgaactggaaagaactcggtggggaggatctccctatccgggtttttcgtttggaagacatcacggagtattatacggaggaagaactgggtccggcttacgagtatgccggtgaaagaatcacgcagttggtggaaaagacgcccggtatcgtggcttttgttccgcagaaatttatagtacagcccgatgcggtgcattttatcaaggataataccatttcggtaaaagatgtctttgcgggtgccgaatggttcccgacagctactcctgccgccttattcggatttctgccgttgatagcgggtactttgtgggtgagtttgttcgctatactttttgcgcttccgttcgggctttcggtatctatctatatgtctgaggtcgccaatccgaaggtgcgtaactggctgaaaccgattattgagctgctgagtggtattccttcggtggtttatggctttttcggcctgatcgttgttgttccgctgattcagaaattctttgatctgccggtaggggagagcggtttggcaggaagtatcatcctggctatcatggcgctgcctactatcataacggttaccgaagatgccatgcgcaattgcccgcgttcgatgcgggaagcaagtctggcgctgggagcttcgcagtggcagactatatataaggtcgtgattccctattcgatctccggaatcacttccggcgtggtgctgggcatcggacgcgctatcggagagacgatggcagtattgatggtaacgggtaatgccgcagtgataccgacaacaattctcgaaccgctccgtacgattccggcaacgattgcggcggaactgggagaagctccggcaggcggaccgcactacgaagcattgttcctgttgggtgtcgtactgttctttataacattaatcatcaactttagcgtggagtatatctcttctaaaggaataaaacgtagcaagtgatatggaaatacgaagtaataataaagcgaaacaccgttctcagaggctggctttcggaatcttccggttgttgagtctctgcatagtgttgattttgtttgcgattctcggtttcattatatataagggagcgggcgctatcagttgggagttcatcacttcggcacctacggacgggatgaccggcggaggtatctggccggctattgtcggtactttctatctgatggttggcagtgcgcttttcgcttttccggtgggagtgatgagtggaatttacatgaatgaatatgctccgaaaggaaagctggtacgctttatacgagtgatgacgaacaatctgagcggtattccttctatcgttttcggtctgttcggtatggcgctgtttgtcaattatatgggctttggtgacagtattctggcgggttctttgacgttaggcttactttgcgtacctttggttattcgtactacggaggaggcgttgaaagcgattcccgacagtatgcgtgaaggaagccgggcattgggggctaccagattgcagacgatctggcatgtgattcttccgatggggatgccgaacatcattacgggattaatccttgctttgggacgtgtttcaggcgagacggcgccgattctgtttacctgtgccgcttacttcctgccgcagttgccgacgagcattctggaccagtgtatggcgcttccgtatcacctgtatgtgatttcgaccagcggaacggatatggaagcgcagttgccgttggcttatggtacggctttggtactgattgtgattatccttctggttaatctactggcaaatgcattgagaaaatatttcgagaaaagagtaaaaacgaattgataagtatatggatacaataaaaatagatgcgcgtgatgtaaacttctggtatggtgattttcacgccttgaaggggatcagcatggagattgaagaaaagtctgtagttgcctttatcggaccgtcgggatgtggcaaatcgactttccttcgtcttttcaaccggatgaacgacttgattcccgctacccgtctggaaggtgaaatccggattgacgggcataatatttatgccaaaggggtggaagtggacgagcttcgcaagaatgtgggcatggttttccagcgccctaaccctttcccgaaaagcatattcgagaatgtcgcttacgggcttcgcgtcaatggagtgaaagataacgctttcatccgccagcgggtagaagagacgctgaaaggggctgcgctttgggatgaggtgaaagataaactgaaagagtctgcctatgctttatccggcggacagcagcaacgtctctgtattgcccgtgccatggcggtatctccttcggtactgttgatggatgaaccggcttccgcgctcgatcctatttctacggccaaagtagaggaactgattcatgaactgaagaaggactatacaatcgtgatcgtaactcacaatatgcagcaggcggcacgtgtcagtgacaagacggctttcttctacttgggagagatggtagagtatggtgatacgaaaaggatattcaccaaccctgagaaagaggctacccagaattatatcacaggacgtttcggctaagcgtcaccggagtgtttgtgaaaaacgagaatattaatcatttatatataaatagactatggtaaagtttatagaatcggaactcattctattgaagaaagaagtagatgaaatgtggacactggtgtacaatcagcttgaccgtgcaggggaagcagtcatgacacttgacaaagaactggcacaacaggtaatggttcgcgaacgtcgggtgaatgcctttgaactgaagatcgacagtgatatagaggatatcattgcattgtacaatccggtggcgattgatctccgatttgtgctggcaatgctgaaaatcaatacaaatttggaacgtctgggagactttgcagaagggatagcccgtttcgttattcgctgtaaagaaccggtgctggatgccgatttgctgactcgtctgcgtttgggagagatgcaggcagaggtattgtccatgctggaactggcaaaacgtgccttgaacgaagagaacattgaaatggcaacggcggtattcggcaaagataacctgctggatgatatcaatgcggaagccacaggtatcctggcagattacatccgcgaacatccggagacggcgcatacttgtgttgacttggttggtgtgttccgcaaactggagcgttcgggcgaccatattactaatatagccgaagaaatagtcttctttattgatgcgaaagtcttaaaacatagcggaaaagtggacgaaaactacccgaaatcgtaattttttgcatgtttttaaacaaaaattagggctacttagaaaataatcctatatttgtcccttgtaacggacaagttatgggcggttttgcgtcaaatgataataaatccaaagaaatttcaaaaagatgttatatgacatgttttataatttggagagtatcagtaaaagcgactatatttgcaccgttatcctgaaaacaatctttttaccttaaaaaaaaactaatacctattgaaaactgaaaaatggagctttgtgaaaagccccattttttttgctctatactgaaggtcacgaagctgtgttatacggtgtttgagagggggtattcttcttcacatctattgcttttctgccttgaaagaaccaatttgaagaacgagtttaagaaccgattattgtaatcgttgataaaagtctttcatataacttttccctataggtatgcgtatattcccgatttttacgacattgcgttctatgttatctattttattaatagctatcagatatgacttgtgaatacgtataaactgcttggcaggtaatagcgactcaatctctttgaaactgagtaaagtcatgattcttgtagtgtcggtgatcacatgaagataggctccttttccttctatatataagatgtcacataggttgatgcgtaccatccggtattctgttttaagaaaaatataatctttgggaagtggctgggctgggggattggatgccatttccgtctgcaccttgttcactgcttttagaaagcgttcaaaggagtaaggcttcagtagatagtcggtgacgtcatattcgaatccttctacggcatactctccataagcggatgtgatgatgatatgcgggcgcgtatggagagctttcagcaactgaataccggtaaactgttccatctgtatatcaaggaacagtaagtctatcgtattggattgaaggaaatcaaaagcatccaggccattatcaaaggtgcctaccaaatccagtaaaggtactttgctgataaagttctttagtttgtctacggctagcggcgcgtcttctactataatacaatggatcatgtgagcttaatcgttaatgaaacatcaaagtaaccgtttttctgattgatttgcaaatcatatctgcgccgatacaagatatccagtcgtcgccttataatattcaacccgataccgctggaggaatctttgttgatctgctttgccggatcgaacatattgaatatttcaaaatgtatctcggatttctgaatctgaaaaaacaggcggatagcttcaggagctttcttatccgtacaatgcttaaaggcattttcaataaacgcgatgaacagcataggggcgacacgaatgttatccggtgatccttccagcgtatatgataccaaattcggattatcatattgtaattgttgcaggtcaaggtaattgtggatatattttagctcctgtgcgagatcaacttcgggagtattggtctcatagatcatatatcgcatcatttccgacatttgtaccagtgattttgaagctttctccggataggaacaaatcagactatcaatattattgagagtgttgaatagaaaatgcggattcagttgatttttcaggagattcagttcactttgaagattttgcctttttaattctttctgtttttccttcttttgaaaccaatcgtatagtatatacaatagaatacctgttacagatgaatacaggaaataactgatgacccatagcataataccataatcgttgtcgcttttcagataataaaagagactaatgaaggcgaaagataaaataaagccataatacccccaaactttctttttggtgtataagtgacagctaagatatgaacaagtcactgtgaatatggaaagataagggatagtctgccccacagaactagcaaatgattggagagaaaagattctggcgcttagagtcgttaacatagtaaatactccattaataaggaaataagcgagaacaggaacaataagtcctatcttccggatgctgatttgtgatgttttgattttcatattttcttcttatttagtaaaacctatcacaaaactccgtttatttttcctctttaaaaaattaaatgaacgaacagacggaatttattcacaagttaacctttgcaagatatgaaaaaaaacagaaagttttccaacttccttccttattcgtatctttgacgacgtattgaagaggtatctcttcagttgaattcaaaatttaaaattcatattatgttttctggaatcgtagaagagtacgctactttggtagcactggtgaaagaccaggagaatatacactttacatttaagtgttcgtttgtaaatgagctgaagattgatcagagtatttctcacaacggagtatgcctgacggtagtgagtctgaccgatgatacgtatacggtaactgccatgaaagaaacgctggaccgttcgaatcttggtttgctgaaagtgggcgataaggtgaatgtagagcgcagcatgatgatgaatggccgactggatggacatatcgtgcagggacacgtagatcagacggctacttgtgtggaaatcaaggatgcggaaggaagctggtattttacatttaaatatgcatttgataaagaaatggcgaaacgtggctatatcacggtagacaagggttcggtgactgttaatggtgtcagtctgacggtatgcaatccgacggatgatactttccaggtagctatcataccttatacttacgaatataccaactttcatacatttgaaatcggtagcgtagtgaatatcgaatttgatatcatcggtaagtatatcagccggatgattcagtatagataattaaaaaatagatgtctgatggattttctgcaattagtactgtctcgtcagagtgaccgggcgtatgataaagagtgtccggtagaagcggagaagctggagcgcattctggaagctgctcgtctggctccttctgcctgcaatgcgcagccatggaagtttgtggtcgtggcggaccatgagctggcttcaaaagtggggaaggcggcagccggactaggcatgaataagttcgccaaagatgcccctgtacatattctggttgtagaagagtctgccaatattacatccttgcttggaggaaaagtaaaaggcaagcatttcccgctgattgatattggaatcgctgctgctcatatcacattggctgcagagaatgaaggactgggttcctgcatcttgggctggtttgatgaaaaagagatcaagcaattgacaggtattcctgcttccaaacgtttattgctggatattgcaatcgggtatccggtgaaagagaaacgaaagaagatgaggaagccgaaagaaaaggtcatttcttataatcaatactaattgaaaaaagattactccttggacttgccggagtagatatacagtaaaaagcctcgttggtttaaaaggaagaggtcgttcctttaaaaccaaggaggctttcctttaaaaccaacgacctgtttcttttaaaggaaaaagtagaagtctttaatctcttgattatgagatatttgcctgaatgtgattctcgaaattgagaattggtaaaaaacaaagacgtttatggggatttctataggtctttcagtagcactttacttgccttcttatagtattcttctctggattcagtcagtactttccattcgtcattaaactcctcatccttgtcgatcttgaagttttcggacccataagtatccagtcggtcgagcaagatggctacattcagctggttaatatccatagagggttggtaaccaatatcttcactcttttggtcggacactacttcatggatcaggtctatttcttgtagttgatagagtacctgattagtcagccggatggggatttgatgctcttccgatatctctgctgctgtataaggcggttcattcttttcgaaacgcttggcgataagcgacatgatcaggatagagataaagtcccgatagcgtctgctgatgttgcgggtatcctgatcgaagctaaagctacggatattttgtccggcatacgtcaattcagctccgaacagacagatggtccatgagatttgcaaccagagcagaaacaaggggagggcggcgaagctaccgtagatagcattgtatttcgatacccataactggctgttgatatacaggaactggaaagcctgataagcggaacctgccagaatacctgcaatcagagcgtgcttgaatttcactttcgtgttgggcatgaagatatacaagcccgtaaacatcagccaagttaatacaaatgggataaggcggatcatgaacttcatgacgggagccaataaaacgaaatcgtccatctgcttcagcacggtactcacaaacagggaaagaccgcccgataccacaatcagaatcggcatgagcaggaacatggagaaatagtccgtaatcttccggtacatggaacgcgccttcttaacttcccaaatacggttgaaagtgatttcgatattgctcaccagattgatcacggtccataacaacatcaccagacctactccgatgaaaataccgcctttggtttgcgagaggtaggagttgacgaaagaaagaatagcttccgtcgtttctatatttcccccgaagccgctccgaaactggtgctccatcaaattatcaaatccgaatccgcgggccacggcgaataggatggcgagtataggcacaatagcaagcagtgtgctgtatgtcagtgctgaggccttgtttgccatccggtctttagtaaatcggttgatgcagagatagatggttttgataatattgtagagcgagaatttcgttctagtcacttcatcttccgtgatgcgccagatgtcatacgtgatgaatttccatatatcggtgattttcttcttcatggctcagaattttaaaaaagcagtttaaaaaagaaaaaaagcagtcagcctgtaagccgagttctgtaccttatagatataaggtgcctgtcatttatctgagtggcgtgtcaccacgacactttagcggtctaccctccgacatggagcgagcagctctcataacgccggtttacatgaccttacaactcctaagacgtacagcccgtatgtcgccatacgactggtaggctcttaccctaccttctcacccttacctctccccgaaaggagcggcggttattttcttctacgttactctaccctcgcggacagctttctgttaggaagtaggatgctctgtgttgcccggactttcctcctgcacgaaacgcgcacgcgacagaccggccaactgctttagactgcaaaagtacgtcatttattttgttttagccaaagaaagtgtcacaaatagaaataatttctacctttgctatcattaaatcatgattcaatgaagaaaaatatcctttttttctattgcttgctggtagtagcggtagttagtctgaaagctcaggaaatacgccccatgcctgctgattcggcttatggggtagtgcacatttctgtttgtaatatgcgcgatgaaggtaagtttacatccgggatgagtacgcaggcgctgctcggaatgccggttaaggtattacaatataccggctggtatgagattcagactccggatgactatacgggatgggtacaccggatggtgattactccgatgtcgaaagagcaatacgatgaatggaaccgtgctgagaagatcgtagtgacttcccattatggatttacgtacgaaaaaccggatgatgactctcagaccgtatcggatgtcgttgcaggcaaccgtctgaagtgggaggggagcaaagggcgcttttacaaagtgtcttatcccgacggtcgccaggcatatatctccaaacatatttcacaacccgaaacgaagtggagagcttcattgaaacaggatgtcgaaagcattattcaaactgcctatacaatgatcggaatcccctatctgtgggcgggaacttcttcgaaaggagtcgattgcagcggtctggtccggacagtgctttttatgcacgatataatcatcccgagagatgcgtcacaacaggcttatgtaggcgaacgcattgaaatagcccctgatttctccaacgtgcaacgcggagacctcgtctttttcggtcgcaaagccacagccgaccgcaaagaaggcatctcacacgtcggcatctacctgggcaacaaacgcttcatccatgccttgggagacgtacatatcagcagctttgatcccgaagacgagtactacgacgagttcaacaccggccgtctgctttttgccacccgcttcctgccttatataaataaggagaaaggcatgaataccaccgaccataacccctattatctatatgactaatcattatccattatcaattatccattatccattcaacaaatgccaaatagaagagatttcctgaaaacggccgcctttgcaactttaggctccggaatagctgtcagtcaggtattggcgggagaatctatagcttccaccattcatataaacaaacagggtatgggaggaaagatgaaaatgacttttttcccttatgagttaaagttgaggcacgtctttacggtagccacttattcgcgcaccaccacacccgatgtgcaggtagaaatcgagtatgagggagtgaccggatatggagaggcgtcaatgcctccttatcttggggagacggtggagtcggtgatgaacttccttaaaaaagtaaatctggagcaattcagtgatccttttcagttagaggacattttgtcatacgttgacagtctgtctccgaaagacacggcggcaaaggcagcggtagatattgcccttcatgatttggtgggaaagctgctgggagctccgtggcataagatatggggattgaataaggaaaagaccccttccaccacctttacgatcggtatcgatacgcccgatgtggttcgtgccaaaacaaaagagtgtgcagaccggtttaatatattaaaggtaaagctgggaagagacaacgataaggaaatgatagagacgatccgttcggtgacagacctcccgattgccatagatgccaaccaaggatggaaagaccgccaatacgcgcttgatatgatccattggctgaaagagaaggggattgtgatgatagagcagcccatgccgaaggagcaactggatgacatagcctgggtgacgcagcaaagccctctgccggtgtttgccgatgagtcgttacagcgtttaaaggatgtggccgctttgaagggcgcatttacgggaatcaatatcaaactgatgaaatgtaccggtatgcgtgaagcatggaagatggtgacgctggcgcacgctttgggaatgcgcgtgatggtgggctgtatgacggagacttcgtgtgcgatatctgccgcctcgcaattttctccggcggtcgattttgccgacctcgatggtaacctgcttatctccaacgatcgcttcaaaggggtagaagtggtgaaggggaaaatcaccttgaatgacttacctggaatcggtgtcatgaaaatctgatcttactgaatgaatgtcagactgttaaagccatctgacatacaacgaatgtaaatttgtcagttgctgtcgttaagcgctgttaagcctcaaatattctctgttaaaagaggacaaaaaagagtgataagtagaataagtgaacgatatttgttattattttaacgtcgtaaaagttaaaacaatgtcgaatattaacattttaaagaattataaatcatgaaacagacaacaaagaacattctgggagtaggagctattattcttcttagctcaggagttgcaggattgacaacttacaaattgttgcaatccaatgatgctgccaaggagacatcttttaatgagatgttccagcagaatcccaatgtcaaattggctgcttttgacgcggtaaacgctcaaccggttgacttgacacaagctgcggagaattcgcttcatgctgtcgtacatataaagtctactcaggaagctaaaacaagaaccgttcagcaagcgccggatatttttgacttcttctttggagacggacgcggacagcagcgtcaggtacaatcccagcctcgtgttggctttggttccggagtcatcatttcaaaagacggatatatcgtgaccaacaatcacgtaattgaaggtgccgatgagatcagtgttaagctgaatgacaaccgtgagttcagaggacgtgtgatcggtactgacccgagcacagaccttgctctgatcaagattgagtcggaagatgatctgcctactattccggtcggagattccgaaacgctgaaagtaggagagtgggtactcgctgtaggaaaccccttcaatctgaactctacagtgacagcaggtatcgtaagtgccaaagcccgtactctgggagtatacaatggtggtattgaatctttcatccagacagatgctgctatcaaccaggggaatagtggtggtgcactggtgaatgcgaaaggcgaactggtaggtatcaactccgtgttgtcttcacctacgggagcatacgcaggatacggcttcgctattcctaccagcatcatgactaaggtagttgccgacctgaaacaatacggaacggtacagcgtgccctccttggcatcaagggagcttctttgggcagcagcatcatggaagaccagagtcctatcgataagtccggtactacactgcgtgataaagcgaaagaatttggcgtggtagacggcgtatgggtacgtgagatcgttgataacggttcggctgccggtgctgatatcaaggtagacgacgtcattgtcggtgtggataacaagaaagtacataactttgccgacctgcaggaagcattggctaaacaccgtccgggcgataaggtaactgtgaaactggttcgtgacaagaaagaaaagtcagtcgaagtgacgctgaagaacgaacagggtactaccaaaatcgtgaaggaagcaggcatggaaattctgggtgctgcattcaaagaactgccggatgacttgaagaaacagctgaacctcggctatggtctgcaagtgacaggcgtttcttccggtaagatgtcagatgcaggagttcgcaaaggtttcatcatcctgaaagctaacgaccagccgatgcgcaaagtaagcgatctggaagaagtgatgaaagccgctgttaagtctccgaatcaggtattgttcctgaccggcgtattcccgtccggcaagcgcggatactttgcagtagacctgactcaggaataagttataaattaaggtaagaagattgtaggataagctaatgaaatagaaaaaggatgccgccatacaacttgtcggcattcttttttgttttattagttgaaaatatagtgaaaaagttgcctaaatatgtatgttaacaaattatttgtcgtaactttgcactccaaatctgtttttaaagaatgagacaactaaagattaccaaaagtatcactaacagagagagcgcttctcttgacaagtatttgcaggaaatcggccgtgaggacctgattacagtcgaggaagaagtggaactcgctcagcgcattcgtaagggtgaccgtgtagcattggaaaaattgacacgtgccaatcttcgtttcgtcgtatctgtggccaagcagtaccagaaccagggtttgagtttgcctgacttgattaatgaaggcaatttaggactgatcaaggccgccgaaaagtttgatgaaacacgtggattcaagtttatcagctacgctgtatggtggattcgccagtctattctgcaagcattggcagagcagtcgcgtattgttcgtctcccgttgaatcaggtaggttcgctgaataagatcagcaaagccttctcaaagttcgaacaggaaaacgagcggcgtccgtctcccgaagagttggcagatgaactggaaattccggttgacaagatctctgatacgctgaaggtatccggccgtcatatttcggtggatgcgcctttcgtggaaggagaagacaacagcctgctggatgtgttggtaaacgacgattcgcctatggcggaccgctctctggttaatgagtctcttgcgagggaaattgatagagctctttctacgttaaccgaacgcgaaaaagaaatcatacagatgtttttcggtatcggacaacaagaaatgacattggaagaaatcggcgataagtttggcctcactcgtgagcgcgttcgtcagattaaagaaaaagcaattagaagactaagacaaagtaatcgtagtaaattgctcaaatcctacttgggataagtgaggaatatcagtttctgaaaaaaaagaattaggggtcgcataagctacacttcttggagtaatcatctgaagaatgtacttatgcgactttttattcagccgttattcgtcaatactatactatgcaccattttatgaagaagtctgctctgatattattcacgcttgttggtttgggcattggcatcgtagccaaggccgaacaacccttgcgggaaaaggcccttgcggcgaaaacctattgcgtagagaaaggatttaatacgaattattgctttctggtagatttcagcattccttccggcaagaaacgtttctttgtctgggatttcaaaggcgattccatcaaatattcaagtctgtgtgctcatggatatggcaaggggagcacgccgaagaaaccggtatatagtaatgtggaaggcagctattgctcttctttggggaagtataaggtaggaatccgttcgtatagtaaatgggggattaatgtacattataaactgcatggattggaatcgaccaacagtaatgctttcaagcgttacattgtgctccattcgtacactccggtaccgactttggagatataccccatgcatcttccattggggatcagtcagggatgtcctgtgatctgtgatgacgtgatgcggaaggtcgatgcgctgctgaaagccgagaagaagctcgtgttgctatggatatatgaatagaaatactaaatcttaatgataaatagatgatatttcctcttttttgttacctttgccacaattaaaaatttatgatatgaaatacgtaaaaatactatttgcaatggcacttgtgttgacaatgtgctcggctttctctttaaagaaagaccactcaaaaacagtttatgccttcggaattgccgcttcctttacggatacagtcgtgtattttacggatattcaaatattggatagcgcaaaggttagcaaggaaggttttctgactcatcgtgatctgtatagctatcagctgaagaattatgtggaagataacggactgcagcagaatagtacctgtatgatctatttctcagaaaacagaaaaaagctggagaaagaagcaacgaagattctgagtaaatataaaaggaacaggaataccacagtaacacggattgatactgataaattccactttataaaaccggaagagtaaaagattaattgttaatatgataagagatgcaggtttgcatctcttatttttttatctttgtggccgtaactaattggaaatctaatgaaaaagattaaaatattatcccttctcatgggtttggctgcgttgtttgcagcttgtgagaataatgaaaacgaaggtcctgaaggacccgaaccacgtgagcaggtaggacgtacagtattggtctatatcgtgggggataatggagttagtgagttatcgagcctttttaaagtcaactttagcgatatgaaggcgggtatggaagaggttgattattccaagtgtaatttggttgtttatagtgagatggtaaatgacgttcctcatctgatttcattgaaacagaagaatggtaaagtagtggctgatactctttttacttatgatgaacaaaatccgctggataaggaagtgatgaccagtgttatttcccaaacggtcagttatttccctgcagatagttatggttttgtattcttgtctcatagctcttcatgggtgccggccagtaataatgcgaactctcgctccatcggatattatcgtaggactcagatgaatataccggatttccgtgaagcattgtcctctgcttttccaaaaccattaaaattcatattgtttgactcatgtaatatgcaatctgtggaagtcgcctatgaacttcgtgactgtgccgaatattttataggttctcctacggagattccgggaccgggtgcaccttataaggcagtagtaccggaaatgtttactgaaacaaatttagcgacgaatatagcagaggcgtattatggatattatgaaaaatcttatacaggagttaagcctgatagtaatgagaattggacgggaggagttgctacttctgtgataaagagtgcggctttggataatttggcagcggcaaccaagacaattattcctaattatattcaagagaagagggaagtagaccgtagcgatatattagcttatgattttaacgatgacgctaattatgattttgaaaatttgatccgaaatttgacaggtggagtggataatgcggattatcggtcttggtatacagcctttgaagcagctgttgtatataggaaaacaactctcaaaaactattccggtatcattcgtagaatgtttactatggaaggttcggagggactttctacatatatacctactggcgaaagtaattctactatgaatactttctatcgcactttgtcatggtacactgctgccggatgggatggaaccggatggtaactatcggttatgcagctttcactaattgcagagcattggcaagtattgatactgagaatgtggaaatcataggtgtgcgaaaatgagccaagtctattgttttggtgctattccacctgcacttgatacggctgcttttgatccttctctaaaatcaagaagtacactatttgtgtcggaggctgcgattgcaacatacagtagcagtagttggaatttctattttaaagaaataacaaaagatttactccatccataaaattcagtaattcaaatgataacaaggttccatcgcttttcttggcaagaaaggtggtggaacctttgttttgtcgcactgtttcgcctgcatctgtaaacctttgcctgcttatttaagtatgatggtagcatcttttctccatccgttcgtattgtttcgtaataagtaaactacttatgtatccatatacctcattgcatcaatttattcaacagaattacgatataataaaacttaagcagatttttccattccttttattgtctttttattccatacgtttgtaagtagcaggctttctttcgtaggtttgtgtattattcacgttcactaattcatggatattaatgatgtagtcgtgatttttatctattgaatcctttacttacgcgtgaatatatattaatgtataaggaaaatagcttttacaattgcagtggaaaaagatactctgaaataacattgtcaatcagatagttacagaaaagtttcaaaaaagtggtagaaaatagtcagatatatttggattgtatagcaaaacctcgtacttttgcacccgctttccaagagagggacagcctaacaattgacattctgctaaagtttaaggcttcagaaaataaaaacaaaaaaacttcgaaaaagtttggaagttatctgaaaaagtccttatctttgcatccgctttcgctaagaaagcagcgcgacagaagtcacgttagttctttgaaatattgataaacaatacaagtagtacaagaaaaaaatagaaccgtaacctttaagaatggactggatagattttatacacagtttgaactgtatgagtttatcagataagacttgtgtataaagggtagcttcccgaaggaggagagttaagttactattgtgtactactgtttagttcattcctttgcactatcgagctaaaaccagcttttcggactaccccaaagaatgttaatgatttaacattcgtctccgggcatccaaagagccaaaaggagaaagggcgtatcatcgttggcagactaaggcatttatcgtatatagaaacggcgctttaacgtagtgttaaagcgccgtttctatatacgataaatagtacactatattttactgtatttcaacaacatacattgcttcatcgccgacatcctccttttatccgccagcagtccgctgtcgccgggattgctgttctgacaacttccggtctgcacgaggggaggacgggtgtgtgtgtcttgccaatccctgcttagaagaagaacctcaatatgtcattgaagtttgcccagatcagcaagccgaacagaagcaccataccggtcatctgagcgtactccataaacttgtcactcggtttacgacgggctatcatctcgtagaagaggaagagcacgtgtccgccgtccaatgcgggaatcggaagaatgttcatgaaggcaaggatgatggaaaggaaggcggtcatgtaccagaactgatgccagtcccacgtagcagggaaaatgcttccgatagtaccgaagccgcccaactgtttggctccttctttcgagaagagatatttcatgttgccgacgtatcctttcaatgtcttcacacccagagagacgcctgcggggaaagattcaaagaatgtgtattcctttttcaccataggcagcagacgatccgttgtcagactggcaactacgcccatcagataagcggaatccacgcgcagggaagtcgtatcggtcacaccgccacgcacatacgtcagcgtgatcagacgagggtcgatgctgtctttcagaagcgtttcggcgtttttcttgcgttccgccatcgtctgcttgaaatcagagaaggagatggattttccgtccaatgcgatgatactgtcgcccggcaggatgcctgcctgcgcagcgggagaattaaccaccacgctgtcaatcacatacgggaaacggaaagaagcaaaacgaacgctgtctgccatcaggcgctgcatcatgtcttcgggaatgtagacggaggccttcttgccgtcacgaagcactgatacctcacgggcatcggctatctgactcagcatatcgccgtcataacgcacaaaaggcacattgtcggcagacaaaaggatgtctccatcctgaaaaccgaccgctttcgccgtttcgttgaagtccataccgaggggagcttcttggacctttatatactggtcgccccaagcgaaaagaatcattgaataaataaaaagcgccaacaggaagttgaacagcacaccgcccaccatgatcagaaggcgctgccaagccggcttggaacggaactcccaaggttgctcaggctgcttcatctgttcggtgtccatcgactcgtctatcattccggctatcttgacgtaaccgcccagcggcagccatcctaccgcatactccgtatcacttctcttgggtttgaacttgaacaaggtaaaccacgggtcaaagaacaagcagaatttttctacacgcaccttgaacaaccgggcaaaaaggaaatgcccgccttcatgaataataacgagcaaggataagctcattatcagttgcagggcacgaattaaaaatgtttccatatagtctatttacaatttaaagcctcatccaaaccctctgctcataagaggaaaaccgaggcgctttctaatttatattacttatttatatttttcattgttcacgaaatcagctccgcagctatcacggaatcagctccgcagctattctccgcgcttcggcgtcggtagccacatagtcgtcgtaagcaggagcggctacaaacgcggcacgttccattgtcttttcgatcacatcgctcataccgaggaagctgatgccgtcccggaggaaagcggctaccactacttcgttggcggcattgacgatgcaaggcatatttccgccccgatacatcgcctcataagccagggcaaggttgcggaaacgtttcgtatccggttgctcgaacgtcaggttcgtgcactgggtgaagtcgagcctgtcgaaagaagagcagatacggtcgggatacgagaacgcatactggatgggcagacgcatatccggcatgcctagctgtgccttgacggcaccgtcctcaaactgcaccatggaatgaatgaccgactgcggatgcaccaccacctcgatctggctgggctgcacgccgaacaaccatttcgcctcgatgacctcaaagcctttgttcatcatggatgcggagtcaatggtgatcttggctcccatctcccagttgggatgtttcaatgcctgtgtcttggtgacggacttcaactgctccagcgtgcaggtccgaaacggaccgccggaagcggtcagtatcaccttctcaatcgggttcccgacttctccagctaaacactggaagactgccgagtgttcagagtccaccggcaaaatgggagtgcggtattgctgtgccagttggttgatcagttctcccgccaccacaagcgtctccttattggcaagcgcaatggctttcttggcacgaatggcgttgatcgtcggcttcagtccggcatagcccaccattgccgtcagcaccatatccaccggtccggcctccacgatctgacagaccgcgtcgattccggcatatactttaatcggaaggtcgctcagcgcttccttcagttgggcgtacttttcttcgttggctatcaccaccacttccggctggaacttgcgtgcctgtgcaatcagcagttctacccggttgttggccgtcagggcataggcttcgtagaggtcggggtgttcttcgatcacctgcaacgcctgcgtcccgatagaccccgtagagcctaaaatagctatttgtttcttcttattcttcttttctgaatccattattatctaattcctctgtcacttgtcacttataatcgtatatcccacttctcgtcattggctttaaaacacgatgtacttctccggattgacaggatgtcccttgtaccacagttcgaagtggagatgcggccctgtgctgagcgttccgctgtttcccaccagtgcgatggcttcgcctcctttcacgcggtcgccttcttttttcagcagcgagccgcagtgcttgtagatcgagacgaaatcctgactgtgctgtacgcctatcacgtaaccggtttcggcggtgtaggtgctcagaaagacggtgccgtccatggttgccagcacgctttcattggggttggcggcaatatccgttccaaagtgtttcttatcggtgttgaaatggtcggaaaccattccacgggtcggacgatacaggatcagtccgttgacatccggctgcgaaacgatcgtagtcagattatatttttcattttcttcgtattggcggcgaaattcctcttcacgtctggtacgttccatcagggtgtcttcgcgggcggcggtcagcgagtcgagcgtctgcacgctgtctatgggcacttttccgctgaaaatatcctgtatgttcatgatgtagaggttctgcctgttgagcagttcctgcaaggaatccacacggagcgcgttgtccacgatctgactgcggacttcactgttcatatatccggggaggtaattgcgcaaaggggtgaaggcaataatgcaggcggcaatcagaaaaagcaccgccagcacggacaacagcaccgaaagcccgttcagcttggatacccgaagccccacgatttcttcaagcgtattctcattgataatggtgagtttatacttgaacttgaaattgttccaaaatgctttactccgttttcttggcatctttattaattattaatcttcctccaaatcttccaaattcaacaatccttcgggaagctcgactgtgatgagcttcttttcctgattgatctccactataaattcttcctgtgcaggaatgaggagttcttctccgtcctcctgttcgaccacaaaaagggtattcaccgttgcggtatccacttcgaccacttcgcccagctcgccgtgacgaacgtcttccatgcggaaaccgacgaagaagttccacgacagttcgccgtcttccgcctcttccgcgtgcttcaccgggaagtagacttcgacgttggtgaacatacgcgcgcgttccgccgtatttatgccttcgagcttcaccagtgcggtggagtccgaacggaaacggtattcttcgatgaaaaacggtacgaaaataccgtcgagcaggcagatcagataatcgcagtccacacggtcgaagatgtcgtccgtgaaggtaaactgcaactcgccgtgaatgccgtgcggcttgttgaatagtccgattttatatacttcttctttctttatcatattcgagtgattctggctccgatggcgttaagtcgtccttcgatgttctggtagccacggtctatctgttcgatattgctgatcgtgctggttccttcggcgctcatagcggcgatgagaagggcgatacctgcacggatatcgggcgaagtcagtcgggcgccgcgcagcttgaagccgtggttgtgtccgattactacggcacggtgagggtcgcaaaggatgatctgagcacccatgtcgatgagcttgtctacaaagaacaggcggctttcgaacatcttctggtggatcagtacgcttcctttggcttgggtggccactacgagcatcacgctcagcaagtcgggtgtcagtcccggccagggggcgtcggcaatggtcatgatggagccgtcgataaatgattctatttcgtatgtttcctgtgcggggacgtagatatcgtctcccctctgttccagtttgatgcccagccggcggaaactttcggggatgatgccgaggttctcgtaggaaacgtttttaatggtaatttcgcttttggtcatggcagccatgccgatgaaactcccgacttcgatcatgtcgggcaatacggtgtgctgtgtgccgtgcagttcttccacgccctcgatggtgagcagattggaagcgatgccgctgatctttgctcccatccggttgagcatacggcagagctgctgcaagtagggttcgcaggcggcattgtaaatggtggtagtgccttttgccagtacggcagccatcagaatgttggctgtaccggtcacggacgcttcatcaagcagcatatagctgccctgaagcctgtcggccgttatctcatagataccccgcgactcgtcataacggaaatcggctcccaaattctgaatccccacaaagtgtgtatccagacgacggcgaccaatcttgtctccgcccggcttcgaaatcaacgccttcccgaaacgtgccaccatcggaccgatcagcatcaccgacccccgaaggctcgaacacttcttcaagaactcatcactctccaaataagccagatcgacgttctccgccttaaaactgtaggtatcaacgccttcctttgcaaccgttactcccatctcccgcataagctgaatcagattgttgacatccagaatgtcaggtatattgttcaccgtcacttcctcagcagtcagcaacgtggcacagataatctgcaaaacttcgtttttggctccttgcggatgaatttccccgctaagccgatgtcctccttcaattacaaatgaagccatttattttaagtattaagtaataagtattaggtattaggtattaagtattaggtattagaccgcaagtgcaaaatctcatacagcaaacaacatcgccgcgctaatacttaatacttaatacctaatacttcaatatcttctccgcggattattattccgattattattgtagttcacctttgggcggtagttctggttcagacgttctgccatcagtcggacgatgtcgtctgtcagttggagtttgccgccggaaagttcgtcgaggtcttccgcaattttacggtcgtctacggtatctttgttccatgccatgtagtctttcttcatgtggttgcagatcatggctgtcagatttctcttgtcgtttccttcgggaagttcgcaggctttcttgatcagtacttccagcgtgtgtccgtagtggcggtagcgcatacgggtggtagaatatgggatcggttccggcttggtcaccaggttgtcttcgcggatgatttcgtagggatagtcaatatccagctcaaaaccggacatgatggccaggtgatcccagagtttatgcttgaaatcgggcacatcacgcaaatgggggaacatatttcccatgatgttgataattgtgttagcacaacgctgacgctcggcacggtcctgaatggtcaacgcataatctaccatgttctgtatgctgcggccgtactcgggaagcggcattcttttctgctgggtattgtattgcatcttttaaattaaaagttttgaaattaaaaattaaaagtcggaggacgacggtcactcactaatcactgtttcccgccaaaggcggttcacttactgaagcgctttattcaactgaagtgcgttattcaactgaagtgcgttattcaagaagtgacttcttcggcaacgaggctacaaattctttcagatagaaaggttcgaagtaggccacatctttatagtcttctctggcaactgctttttctgccagcggatacatcatcttcgccaacggatggatgtcatcgataaaatgcgcattcggatgcgtgatcttctcgcggcacttggcggctccatttccgtagaaataaacgggcgcttcgttcagaaactccagataggagttctcatcgacaatatcggcggcgatagcgcgcttcacgttcaatgcacggtcgtaaacggcagcgtacacttccatacggcgggcatcgagcatcgggcagagcaacgcatcttccggcaaatcgtgatacagcaacacgggcacactcagcacttcgagcgtaggaagaccgatcaagggtacattccgtccgtaacaaatgccttttgccatcgaaactccaatccgcaatcctgtgtatgatcccggaccgcaactcactgcaactgcatctaaaggtatggcatgactatcaatgaacgacaacgcttcatcaacaaatactcccaaagacacggcgtgtgaagggcccttcaagtcttctttcacaaaaatcgtctgtccgtcttgacttgccgctaccgagcaaacagtggtagaggtttcaatattcagtatacacgacataaaaatcagcttattaaattgtcgcaaatttacatgattatttccaattcttaaaatattcgtgtacttttgcacaaaactttaagtatatgatacagtcgatgacaggatacggcaaagctacggccgaacttccagataaaaagataaacgtagaaatcaagtcgctcaacagcaaagcaatggatctttccactcgcatcgctccggcttatcgtgaaaaagagatcgagatccgcaacgaaatctccaaagtgctggagcgtggaaaggtggacttcagcctctggatagagaaaaaagagagtgcggaaagcgcgactcctatcaaccaagtgttggtggaaggctactacaaacagattcaggcgatctcggaaaatctcggcatccccgtccccaccgactggtttcagacgttgctccgtatgccggacgttatgtctaagactgaaatccaagagttgacggaagaagaatgggaaatggtacgtgccaccgttctcgaagcaatcggtcatctggtagacttccgcaaacaggaaggcgccgcactggaaaagaagttccgcgaaaagatagctaacatcgcactgctgctcgaaaagataactccttacgaaaaagaacgggtggagaaagtcaaggaacgtatcaccgacgcgctcgaaaagacgctgaacacggactacgacaagaaccgactggaacaagagctgatctactacatcgaaaagctggatgtcaacgaggaaaaacaacgcctcaccaaccacctgaaatatttcatcagcacgctggaaagcggcaacggacaaggcaaaaagctcggtttcatcgctcaggaaatgggacgggaaatcaatacgcttggcagcaagtccaaccatgccgaaatgcagaaaatcgttgtgcaaatgaaagatgaactggaacagatcaaggaacaggtgctgaacgtaatgtaattatttaatagtaagttgaaaattgaaaatgtcgacattttcagttttcaactttcaattctcaattaaacaaatgactggcaagttaattattttttctgccccgtccggttcgggcaaatcgactattatcaactatctgctgacgcagaacttaaatctcgcgttctccatttctgcaaccagccgcccaccgcgcgggacggagaaacacggggtcgaatatttcttccttactcccgaagagttccgttgtcgcattgagaacaacgagtttttggaatacgaagaagtatacaaggatcggtattacggaacgctgaaagaacaagtggaaaagcagttggagaaggggcagaacgtagtattcgacttggatgtagtaggcggatgcaacatcaaaaagtattacggtgagcgtgcattgtccatctttgtacagccgccctccatcgaagaactccgttgccggctgacgggtcggggcacggatgagcccgaagtaatcgaatgccgcatcgcaaaggcggaatacgaaatgacttttgctccccagtttgatcgtgtcatcgtgaatgatgatctggaagcggcaaaggctgagacgctggaggttatcaaagaatttctgaataaggaatgaaagaatctctgaaaaaacgaatagagagcatagaaaagaaggagggatcgaccgaaaaattcatgtatctgtgcggcattatcggcattgtagatatagtgttcggcatcctttcactttatctgcatttttggattgccgccggcatctttttcttaattgctgtgaggcaggctatcgtttttccaaaatggagaaaaaagctgagaatggaaagggaagccaagaagatgacagaaagtcaaggctgaaaaagaaagtctaaaagagaacccaaaagagcaaaaaaagaacaaagaatagaaagataagaaggcatcaagaagaaaaaagtaaaaacgagaagatgagaatggcagagagcaataaactaaaaaccggaatcttcagcgggtcattcaatccggtacacatcggacatctggccttggccaactatctttgcgaatatgaagaactggatgaagtttggtttatggtcagcccgcaaaacccgctgaaagcagggacggagctatggcctgacgacctgcgtctccggttagtagaacttgccacagaagaatatccccgcttccgctcttcagacttcgagtttcatctgccccgcccttcatacagcgtacatacgttggaaaagctacatgaaacctatccggaacgggacttctacttaattatcggctcggataactgggcccgcttcgaccgctggtatcaatcggagcgcatcatcaaagaaaaccgtattcttatctatccccgccccggatttccggtaaatgaaaacgggctgcccgaaacagtccgtctggtccattcgcctacctttgaaataagttcgacgtttatccgtcaggcacttgatgagaagaaagatgtaagatacttcttgcatccaaaggtttgggagtatattagagaatatatccgacagagtataacggataattaatcatccactcttgcttccgataatctgacatagaaaatcgtactccgtgtaatcccgcatttttctctacgaagaaacgcaaactcttcgattgcagattttcctcagcttttacttcaacagggatgacgctaacatctttttgtaaaaggaaatccagttctcctctggatgtatccgaagaccagtagtaaatactcagtcctttcactgacttcaattgttgtaatacatactgctctgtaatagctcctttataatcactaaacaacacattcccctccaataacgcttgcggtggaagcccgctcatagctcccattaatccggtatctaacaaaaataatttaaatgccgaaaagtcctcataagccgacaatgggattccggcttttttcactcggctaaccttgtaaataagtcctgcatcaatcagccactcaatagccaactcaaaatctttcgctctggctccttccttcacgacaccataaataaacttcttattttccttagccaattgagccggaacagaacgccaaatcatacgaatccgaggcacttcggcaataggagcatgtttggagaaatcacgatcataagaatccagaattgtctgctgtagctgtcgcacttcggcatagtctttatgattaataaaggcattcacaacttcaggcattcctccgacataataatactgtttgagcaaatctatcaatttagaacgaaaagcagcgatcagcccccagtctttttttgcaagtaaacgggcaaaagcctcttgcccgacagcctccaaaaactccgaaaaagaaagaggatataaatccataaaatcgaccttcccgacgggaaaagaatcattgctatgcatggcaatgccaaggagggaacctgctgcaaccacatgatactgaggagctttttcttgaaaatacttcaatgccgtcaatccgcgaggcgcttcctgaatttcatcaaaaataattaatgtctcagtatctactacgatgccggtcactaattgaatagccatcagaatgcgctcgacatcaaagtctttctgaaaaacatctttcatcacttcgttatcctcaaaattgatgtaagcaaactgtctgtaagctgatgatgcaaattctttcatcaaccatgtcttccccacctgccgggcaccacgaacaatcaaaggtttccgtgttgtcttctccttccagtcatataactgttgcattgcatctcttctcatatttattcttttataatcaacgatttatgaactgcaaatataagcaactgaatagaaaagaacaaaaagtcatgcataaaaatgtgctaataacacaaaaagtcgtacctaaaagtgtggagttcatcagaaagtcgtacctaaaagtgtatctactctttgagacgatgaagcgtaatcattatgatttctgccggagcaccgattcgtacaggcatctgagaagtaccgatcccattagtaacaatcaatggcattttagttgaattgtacgccagtccggtcagaaagcgggtgccgtagtgggagttctgtatcggggcgtaaccgaatacgcgtacctgtccaccatgagtatgtcccgccaaagcgatgtccgtgttggccaccgaaacatcctccacgtagtcgggagtatgcaccaacaagataacgaagtcgttgggagaaagcgccagtgtgggcgacaccccattttgtttcaagtcgaaaggattgcgtactccggcaaggataatctgctgaccgtctttgcgtaatgtatcgacttcgtgttccagcggacgcatcccgtaatgcttcatcgtgcggattatttcgtcatggcagcgttcatagtcattatttcccattactccgaaagttcccatcggtgttttcacacgggccaatgcggcaaataacggttctacgtattcacagccttcctgatagtctcctcccatcagcaagacgtccggtttctgggcgatcaaaagatcgacaaggttgttcaagcctttctctttcagcagactcttgtaatgcaagtcggaaatgaaggcgatgcggaagccttcgaaggcttcggggacatcacggtgggtgaagtcatattccacgacacggtctatgccgctataagtggcagggacgttcacggtagaagacgtgatcttcgttccgcgaagtaccaaattacgttcttcctgctcggtcgcagcttctttcttcgctgttttcttctgctttttcgtcgaaactttcaagtcggcaagctgagaatgatccggagcaaacaagccgtcgatagcggcggaactgtccggacggacggaatcgacattgagcacaggacgaggcaggatcgatacaacattcttctttgacttacaagatacgaacaggaataatacgaatattatgaacaggtaatttatttttttcatcttctttggtttattttcttctacatataacacattcccccactatttgaggcgcaaagataggaaaaatcatgtatctttgtccgtcaaaacttattattatatattaaagcatggaagaagtaaagcgtaactcgctgcgtgcgtggatattagcagcacgtcccaaaactctgacaggagccattacgccggtcatgatcggtagcgcacttgcttatatggatggacattttcaatggttgccggcccttatctgctgcctgttcgccggtctgatgcaaattgccgccaattttatcaacgacctcttcgactacctcaaaggaaccgaccgcgaagaccggctgggaccggaacgagcctgcgcacaaggctggatttcaccgagagccatgcgaaacggaatcatcgtcaccgtcctgttcgcctgtctgatcggatctgcgctgctgttttatgccggatgggagctgatcatagtaggacttctctgcgtactcttcgctttcctctataccacaggcccttatccattatcctacaacggctggggcgatgttctggtcatcgtatttttcggattcgtccccgtgggcggaacgtactacgtgcaggcgctgacatggacttcggacacaacggtagcttctctgatctgcggactgctgattgataccttgctggtagtcaacaattaccgagaccgtgaagcggatgcacggagcggaaagcggacggtcatcgttcgttttggcgagaagttcggacgctatctttatttgatgctgggggtggcagcaagtcttctgtgtttctggttcttcttcgaaggacacttgtttgccgcacttcttccgttactctacctgattcctcatgtcctcacatggagacggatggtgcagattcacagtggtaaaaaattaaacagcatactaggtgagacttcacgtaatatgctgttaatgggtattttgctatcaataggattcttgatccgacattgatttattttccgtacatcttttcgtaataaccttgatagtctccgctggtcacctcttccacccagtcttgattttcaagataccatacgattgtcttcacgatgccatcttcaaatttcgtttcgggataccagcccaaggcgttcgtgatcttcgtgggatcaatggcataacgctggtcgtgccccagacggtctttgacaaaagtgatcagatcgttgttgatccagtcaacggagatttctccgtcttcacctttcactttctttttaaggacctgacgatattccggtttctcggtcattagtttacggatagtggcaatggtcagcttcacaatttcaagattggtttcttcgttgtgaccacctacgttgtacacctcgccctctttgccttcgcgcactaccaagtcgatcgctttgcagtggtcttctacgtaaagccagtcgcgcacgttacttccgtcaccgtagacaggcagatgtttgccttcgagtatattcttgataatcagcggaatcagtttttcgggaaaatgataggggccgtagttgttggaacagcgggtgatcgttaccggcattttataagtgtcgtgataagccatgactaccatgtcggcactggttttcgaagcgctgtacgggctgtgcggacaaagcggggtttcttccgtgaagtagccttccgcaccgagtgagccgtacacctcgtcggtagatacctgatggtagcgcactccttttctccaggtaggatatccctgttcgtccttacccatcacccaggcacggcgggcacaatccagcagattctgcgtaccgaggatgttggtgatcagaaacagttgcgggttttcgatactgcggtctacatggctttcggcggcgaagttcacgacatagtcgaaacggtattcggcaaaaaggctgtccaccacttcgcggctgcaaatgtctcctttgataaagaaacaacgttcgttatcgatatctttggcaatagttcccagattacccgcatacgtcagggcgtcaagaaccaccacttttatatcgctgtgcttggccaagatatacttaatataattggcgccaataaatcctgcggcaccggtcaccagataagttttcatatatgattatttatgtttatttcaagggttgtttagacagttctatcaggtatttaccgtattcggtcttttcgagtttctgtccgagcagcagcaattgtccggacgaaatccatccttgccgccaggctatctcttcgatacagctgacgtagaaaccttgccggttctgaatggtagccacgaagttggaggcttcgagcaggctgtcgcagtttccggtatccagccacgcgaatccgcgaccgaacagttccacgttcagtgttccttcttcgaggtacaggcggttcaggtccgttatctcatattctccacgtgccgaagggcggagagaagccgctttttccgtcacggtagcgtcgtagaaataaagtccgggaacggcataattacttttcggcaccagtggcttttcttccagagaaatcactttgccttgttcgtcgaactccactaccccgtaagcccgaggatctttcacgtaatagccgaagatgcaggctcccttctccacaccggcagcacgccggagcatagcggaaaacccttgtccataaaacatattgtccccaagaatcagacaacctgcctcaccattcaagaaatcagctcccaacacaaaggcttgtgccagtccgttaggctgctcctgtattttgtaagagaaagacatcccgagctcctcacctgagcccaacaagtcccgaaacatcggcaaatcacgcggagtagagatgaccaagacctcccgtatccctgccagcataagcgtagacagcggataatagatcatcggcttgtcgtatacaggcatgatttgtttggaaatcgctttggaaagcggataaagacgagtggcgcttccaccggccagaataattcctttcattgtcgtctgagttattcattttactgtgtgcaaaggtcggaaagaaatctgacgtgacaaaatgaattgtaagaaatctatcctgccagttcaataacttcgaggtctttgaacgttccgttgtcgatgacaaagcgcaccattgtccgcactttatggaaaccggacatccctgcggctccgggattgatgtgcagcatgtccaacgttttgtcgtatttcacctttaatatatgggagtgtccgctgatgaaaagtttcggcggacgtgccatcaaactgccgataaccgaagggtcgtacttgcccggatacccgccgatatgcttgatcagcacttccgctccgtccaccgtgaagcggttcacctgcgggaacatcttccgtatttcttgcccgtctatgttgccgtaaactgcccgcaggggccggaaagccgctagcttctcggctacttctaccgaaccgatatctccggcatgccagatttcgtcgcacgattcaaaatattcgagatatttttcgtcccaataagcgtgggtatcggacaataatccaattcttgtcataattttctttgtttagtcctgcaaagatactatatttgggaaaatcttaaagcacatggaaagcaaatataattatttcaaacgtgatatcagctggctctcattcaactatcgggtgttgctcgaagcgctggatgagcacctgccgctatacgagcgcatcaatttcatctccatctactcctccaatctggaagagttttacaaaatccgggtggcggaccacaaggccgtggcatccggcgcaacggagagcgatgaagaaaccgtacaatccgcccgcgaactcgtggaagaaatcaaccacgaagtaaaccgccagctggacgaccgtgtacgcatttacgaagaaaagatactgcccgccctgcgcaaaaaccacatcatcttctaccaggacagacatgtggaaccgtttcaccagcagtttatcaaggactttttccgggaagaaatcttcccctacctgcaacccgtgcccgtatcgaaagacaaaatcgtctcttttctgcgagacaaccggctctacctcgccatccgcctctatccgaaggaaaacaggaaccccgccaaccggcagcctttctatttcgtcatgaagcagccgtacgccaaagtgccccgtttcatcgaacttccgccccgtggaaacaactattacatcatgttcaccgaggacatcatcaaagcgaacctcaaccttattttccccggctacgacgtcgattcgagctactgcatcaaaatatcccgtgacgccgacattctgatagatgacaccgccagcagcgccgacctcgtagcccaactgaaaaagaaggtaaaaaaacgcaagataggcgacgtctgccgctttgtctacgaccgtgccatgccgcaagacttcctcgactttctggtcgacgccttccgcatccaccgtgacgaactcgtccccggcgacaagcacctgaacctcgaagacctgcgccacctgcccaacccgaacaagtctctacgccgcatcgaaaagccgcaaccgatgaagctgaacatcctcgacgaaaaagaatcgatcttcaactacgtcgcccaaaaggatctgctgctgtattacccgtaccactccttcgagcacttcacccacttcctctacgaagcagtgcacaatccggagacgcgcgaaatcatggtcacccaataccgtgtagccgaaaactcggccgtcatcaacaccttgatagccgccgcgcagaacggcaagaaagtcaccgtatttgtcgagctcaaagcccgtttcgacgaagagaacaacctcgccaccgccgaaatgatgcaagccgccggcatcaaaatcatttacagcatccccggactaaaagtacacgccaaagtggccctcgtccgtcgccgcggactgaatggagagaaaatccccagctacgcctacatcagcacgggcaacttcaacgaaaagaccgccaccctatacgccgactgtggacttttcacctgccgcaaggaaatagtgaacgacctttacaacctcttccgcaccctgcaaggcaaggaagatccgaaattcaccactctcctcgtcgcccgcttcaacctcataccggaactgaaccgcctcatcgaccgtgaaatatcccttgccgaccaaggcaaaggcggacgtatcatcctcaaaatgaacgccctccaagaccccgcaatgatcgaccgactctacgaggcctccgaacacggcgtgcagatcgacctcatcgtccgcggcatctgctgcctcataccggagcagtcatacagccgtaacatccgtgtcacccgcattgtcgacagttttctggagcacgcccgcatctggtatttcggcaacgaaggccaccccaaagtatacatgggctcgcccgactggatgcgccgcaacctctaccgccgtatcgaagccgtcacccccatcctcgaccctgacctgcgcgccagtctgatcgaaatgctccatatccagctcgctgacaaccaaaaagcctgttgggtagacgacaaactgcaaaacgtattcaaaaaaagagcatccggcacccctgctgtccgtgcccaatacgatttttatgaatggctcaaaaaagacattgtaacagaaatgtaacacgtatgacatttttccgcaacgttaaactccgttctttgcctccataaataaacatacacaactttctttatggagacaatttacttatgcattatcattttcctgttcgtgctggccgtgttcgatctcatcgtcggagtcagtaatgatgcagtcaactttctgaattcggcggtaggcgccaaggccgcttcgttcaaaaccattcttttcatagccgggatcggtattttcattggcgcatccctgtccaatggcatgatggatatagcccgtcacggaatctatcagcccgagcatttctactttgccgaaatcatgtgtatactgctcgccgtcatgctgaccgacgtagtccttctggacgtcttcaactctatgggcatgcccacctccacgaccgtctcactggtcttcgagctgctcggaggaactttcgccctctccctgatcaaagtaaacaatgacgccacccttgcgttgggcgatctgatcaacaccgacaaagcactttccgtgatcatggccattttcgtgtccgtagccatcgccttcttcttcggtatgttagtacagtggctcgcccgcatcgttttcacgttcaattacacgaaaaacatcaaatacagcatcggccttttcggtgggatcgccgccacctccatcatctacttcatgctgatcaaagggctgaaagacagctccttcatgacccccgaaaacaaacaatggatacaggacaacacgctgctgctcatcgccagcttcttcgtcttcttcacggcactgatgcaagtgctgcactggctcaaagtcaatgttttcaaagtagtggtgctgatgggcacctttgctctcgccctcgccttcgccggcaacgacctcgtcaacttcatcggagtccccctcgcaggctactcctccttcatagactacaccaccaacggagccggagcaagtccggacagcttcctgatgacctcgctgctaggccccgccaagacaccgtggtacttccttatcggtgccggcgccatcatggtctacgccctctgcacctccaaaaaggcgcacgccgtcatcaagacctcggtagacctctcccgtcaggatgaaggagaagagaacttcggaagcaccccgatggcacgcacactggtacgtttcagcatgacacttgccaacggcacctcccgcatcatgcccgaaagcacgaagcagtggatcaactcccgtttccgcaaaaacgaagccatcatagccgacggagccgctttcgacctcgtccgcgcctctgtcaacctcgtcctcgccgggctgctcatcgccttgggaacgtcgctgaaactgccgctctctaccacctacgtcaccttcatggtagcaatgggtacgtcgctcgccgaccgtgcatggggacgtgactccgccgtctaccgcatcacaggcgttctgagcgtcatcggcggctggttcatcactgccggagccgccttcaccatctgcttcttcgtagccctcgtgctgcactacggcggcaacatctccatcatcgcactgatcggaatagcgattttcatcctcatccgcagccaggtgatgtacaagaaacgcaaggcgaaagagaaaggcaacgaaacgctgaaacaactcatgcagaccgccgacagcgaagaagcgctgcaactgatgcgtaaacatacccgcgaagaactcgccaaagtgctggagtacgccgaaacgaatttcgaactgaccgtcacctcctttatacacgaaaacctgcgcggactgcgtcgtgccatgggttccacgaaattcgaaaagcaactcatcaagcagatgaaacgcaccggaaccgttgccatgtgccgcctcgacaacaacaccgtgctcgaaaaaggactctactactatcaaggcaacgacttcgccagcgaactggtgtacagcatctcgcgcctctgcgaaccgtgtcttgaacacatcgacaacaacttcaacccgctcgacgccattcagaaaggtgaattcagcgacgtggccgaggacatcacttatctgattcagcaatgccgcaagaagttggaaaacaacgattatcagaatatggaagaggaaatccgccgtgccaacgacctcaacggacagctatcgcaactgaaacgcaaagagttgcagcgcatccaaagccagtcgggcagtatccgggtaagtatggtttatctgaccatggtgcaggaagctcaaaatgtagtgacttacatcattaacctgatgaaggtaagccggaaattccaaatggaaacagaaatgccgtaaggtagctcatcccccaaaagcacacaacaaaagggtttatcttcaaaaagtctatctgattaaataaaatgcattagagataaaccggaaaaagcaagaagggctgctcccaagtagaattggggcagccctttttatggttgggcggttgactgttatccaatctgccgggatattcttttatagatgtcaaaattctccaactaccgcattatcgggctcaaaaaacataatgtagcaaacaggggtataggtgaccccattttttgataatacacttttccataaatcctacatctcagagcaggtatgaatcatttcgcacaagaaatgaaatgaattaaattccactacctattactatacaattacctattactttcccatacaaaaatcccctttattcaaccccatatcatagacagatacggttttaaataaaaggggattctctagtttttaagagaggaggtcggtttatgaatctcccgtctttttagctttccgacgacggaagcgcaagagtgcttccaaaatatccaataacttttctaaaaataatttcatagcttccttctttagagttaaaaaacagagtgaatggagcaatttaataagggaaccgatcatgcattagtgagtcagcgattcagcctcattaaacggttgggtccggagcctcatcgtcgtcgcctccgggagtgcttcctccgccggggttgtctccgcctcccgaatgatttttatcatcgtcgtccacaaagccgcccgctacgtccttgacgtggacaaattctactccggaagtcagtgcacgggtagtgacgccatcggcagaacgggtatattcgggagtaaactgacagcgcagcgaaacgatctgcgaactgctgactttactttccaacacgactccctttcctccggctttggcgatcatcgtaaatgtgcccaagccttcgagacgtactgtgcggctgttgagcaactgttcacgcatcacggacatcaagtttcgaatcacgttgtggacatcacccggcgtcagagaagccttctcggcgatcagctccgccatcttctgcgtgttgaccattttcgagaatttcacgaggcgggggtaatacagtttctgtcccgctttgttggcgatattcgcctggtaaggtttgtaaattaatggcataaggttgttttcctttctttttttaatggttgatgtaagttttctatgtgcaatcgattacggtgacaaaagtaggcgatggcaaaaaagtccggatacacgatgtaacgacttgtaactgaagagcaccagtcggcacggcttcgcacaaatactgcctccaaggacttctgtacaaagcaacaccaaacgactaaaaaaggcgtacctttacattggcaacgaaaacgaaaaaaagaaatatagaaaagatagtaaaagcagtatcaaaagacaatgaaagcaaaaatcatgaaaccaacttccgaagaaaatgcaaccctgccccgcatacaggcatacagcaaaagccaactggccactctctacctgccccacatacagcccgcctccgcacgccgcactctccgcagctggatcgccaagaacacggcactacaaaacgaactcgcccgcacgggatattccgacaaagccatcctgctcactccggcacaagtagggctcatcttccgtttcttgggggagccttgattcgagctgactatccgcatggcttcccctcccttcgggaaggggctgactaaaaagtcccattcttcgggaagcaagtatatttccgtcacgccacgtccctttcaaaccttctcttcgttggccgtataaggcagcgtgaaccaaaaagtactcccatgccccagccgtgagacagcaccgatctttcctcccatcctttcgacgattgcccggcaaatggtgagtccgagtcccgtgccctgcacaaagctgttgagtttgacaaaattcccgaagatttcttccaaccgttcctccggtatcccgcaaccggtgtcggtgacatagaaatgcaggaaaccgtcttcgcgcacatcaaacccgaactcaatgctgccttccccggtaaacttcacggcattattcatcagattcatcatcacctgtaccagacggttacggtccgcctttacgacacattcggtcgtccggcggtgatagcagatacagatgccggactttttattcctcaaccggaacgtatcttcgagttcgataaacaggccgtgcacatctaccggggcgtagtcgaactccatcgttccggcttcgatcttcgaaaggtcgagcacatcgctgataagctgcaacaggagtgtgttgttgttttcaatgatgttgatatattcctgtttctcttccgaaatccccctttccgccgacaccagcagcgaggaaaagccgacaatggcgttgaggggagtgcgtatttcgtggctgatgttggcgaggaaagaagatttgagcgtgttcgcctcctcggctttcacctttgcctgtacgagcgcttcctccatttcctttcgttgggtgacagtcatcgaagtgccgataaggctcagcggttttccgttcgcgtcgcgctcgtccacggctgcgcgcacttctacccattcattctgttgcggggagggaagccactgtctgcctacccgatattcctcgcgcattttctgcgtttcgccattggcgaggcgctcgaaggcgtcccgcacgcgttcgcggtcttcatcgcagattttcgcgaaacaggcggaggtgggcacgataatcaggttgccgtcatgcgtcacctcctcttcggtgacgtacaagtcgtggctgacgttgcacgagaggaggccggtctgcaaatcccatttccaaggggtcatgtcggcagcgtcgagggcggcggacaacttatggttggtggatttcagcatttgctgcgtcagcaccagttcggtattgtccacaccaaagacatcgacgcagcctttcgttttggaatgtatggagatgacggtcagatgagttttcgtcttctccagataatactgaaaggttatttgcctgttgtcattcagttcgctgtacctgtcgggcagttccggcgaataatccggattgagttcgctgtatttctttcccagtattttttctttgggcaggatgtatttctcgaaagtgggattcacttcccggtagacatagtcgataatccgggcaccggggtcgaatatgagctcgacacggacatagagaacgggcatgttttcgaccagactgctatagctcctcatgatctccagccgcctgctcctctcatgcagcgccctccggagccatatcacatagatgacggccagtgccatcaaagagaaaaacagggccagataatatttgttccgctcgaaaaaagtggggggcttcataccaaaaacagtgtcgtcgggacacaggccgagcaacagtccgctctctacgtagtcggcataattgatgacggatgggggcgtccccatcgctgtcgtttccactctgtgcggatgcgacgctccgtccaggcggcttttgatcaccgggagcagatgtttctttatttcactgtctgtccagaaatagccgccgatcaacaggaaaggcatcacttcctccgcttctttcctgcattgcgcactgatccagcgcctgtcggacatgaagacctgtttgcgcatatccgggacaacggtcgccatcagttccatgtgctcggcacatatgtcaaccgggctgttctggacgcgaaactctttatagacaggggccataaagtcatcgctccacagacagttttcggtataagaattgatgattaatagttgacaagaagaggggcggccggcataaatgtaagtctgaaatgcactgatcagaaagattgcaagtgccgctgtttttcgagttatccgcgcttccataaatagtgattgttttgattgtttgcggaaccgatcactgaatatcttaaaatattgctattaaatctttaaatattactatacaaaaaggtaagttctgtaagaacttggtagagcgacttatctgccagtttataatatattactaaagaaataaaaacaaacagacttattaaaagccgtcatctgcattctcagctcggaaaacggattcgttttacccgaactgagaatgcaataattagaatttgtaaataatgacgaacgtgcaatacggtagaaaccgacaaaggaaaacaaataaatatctaaaagagaaaacgtaggatgtcaacatcgaatatgaaatctgagtgaacaataaaacttatttttcagaataaaagcgtttctgcatggttttctcaataatatgattacatttgtggtgacattataacaagggaataaaatggaagtccatcgctgatatcgaatcgtttttttacgaatacagactaccaagttcttacaggacttacctcattccgtcagttgttctttcctttgtcccgatcattgtcgtcgctcaaaggtgttcgtcgtctttaccttcttttcctttttcgttcttttcctcgtctttcatgcgcaataatttatctttaccgaaatttatttctatcaccactttcttgggcgagtcgatatggtaactcacaattccggcatctctaatcaagaacataataatgacaaccagcatcccgaccagattttcggcaaagacacaattgacggacacgcagtgcgctaaattaaaaatcgtcgtccaattggacattctctttcccatccaggccgagtggaagcgcttgatcgacgatgccgaacagtccgaatgctgctgaagataagcgtcgtcaaagccgttatcccggctgactttcataatcgaatcgatgactttctgtttttcttcgtcatcactgtgctgcaagccattacattgctttttcttccattgcttctcttcgactctttcctgaagggcatccctgttctcgtcatacacggacttttcgccactctgatttgcttttttctgactcatgcttttctgatttgctttttcctgactcatgcttttctgatttacttttttctgacttgtacttttctgatttacttttttctgacttgtacttttctgatttacagtcctttttacttcaatgtgttgttctctttcactactgttctggcagttttcttttttgttcattactaattatatttaaattaatccgacaaaattcgggatttacctttaacattttgggtcacgcgtgactctttctacatattttttcattttagtcaagcgtgaacggtttttattctacccacagtctacttttgccccgaaatcaataaaaaacaattgaatcatatgactgaaatgaaaaaacaacattccctcccacgggtacggctcatgaggcgggccgccgtcatccgtcgcaacaatgacatgaaccggcgtgatgcgctcatcatcgcccaccgaatcggtggactgataaggaagatgcacagggagaacgtgaaattctgctacaccaagcaggacggaaccgtgcgccacgctgtcggcacgctcaccggatatcaacacagttttcaccgcccctatatgccacgaccggaaaatacgtttgtagtctactacgacctcgaagccaaagggtggcgcacgtttcatgccgaaaatttcctttgcgtcgaatgagtttcgaagagcagatgagattcggagagcaaatgagtttcgggcagcagataaattttgaaatgagtttcggacagcagataagttttggacagcaaatgaatttcggagaacaaatgacttcagaagaacgaaaagaatgggaaacgctttgcagaatgtatcatgtggactctttgtacgaagccattcaagggtgtcgggaggaactggagtttctcgttcgctgtgccgaacggctcgaaccccgtgcagaggaggaatgagaaaggtcaaagaccggagtaagcgggcggaaccgcctcatgtcagcgaggaggctacgccgtttaacagtccttgtttatgccgtttttaccttgcaggctacgccgtttctaccatgcaggctgcgccgtttatccccggtggtttcggaaaagggatttctttttaacgaagtataattttattaacaatataaagaataaagtatggaaaattggagatttatcgaagcaaattccgattatatggtttcagaccacgggcggatattgagtttcaaaggcaaatcgaagttgataatcagcagcagcattaccgcaaaaggttatgagtacgtggccatccgccaaaaggggatatacgtcggctactctgtacaccgcttagtggcaacagcttttatccccaacccgaagcgtctcccccaagtgaaccacctcgacggaaacaagctcaacaaccacgtcgccaacctcgaatggtgcgatgcctacgacaatgtcatgcacgccatccggaccggtctgcgtccgtcgtcacccgccctctcccccgtcccctgtgccacaacggacgaggcaggaaatatcctgcaagcctatccatccatgaacgcactggtaaaaggggaacaaatgaaccctaaacaacgtaattggctggtgctgcatttattacaccccgaaagactgaagcaatcggccatgaagaaaaagtcaagagccgaaagaagcggttcggaagaatgctttctgatagcacccgaaatacctgtgctgaccgtcaaagctgattcaatcggggagttcgaagcaggcaatccacttgggataggcaaatcgagcaattcagtcggggagttcgaagcaggcaatccgcttgggataggcaaatcgagtaattcagtcgaggagttcgaagcaggtaatccgcttgggataggcaaatcgagcaattcagtcggggagttcaaggcaggcaatgtatgtgtgcagccagtttctttttcctttgtttcatcgccttttcctcttatttctctctttgcccctatacatcattcagtgacgcagcactattaccgccgcctgtcccccgaagaatccgccatttttggtttcaacacttatatattgcccagagaaagaggacaaagaaaggagtttctgcaatgaaagacaccatcatcatccactgttccgccacccgtgcgggacaggacatcaccgctgccgacatcgactgctggcaccgtgcccgtggcttctggtccatcggctatcattacgtcatccgcctcgacggcaccatcgaaccgggacgggacgtcaccctcgacggggcgcattgtatgggctggaaccagcgttccatcggcatctgctacgtcggcggactggacaaggaaggccgccccgccgacacacggacagatgcacaacgcaccgccctcatccgactggtgaaatctctgcaactggccttccccaacgtgaaacaggtcatcggacaccgggacacaagccccgacctcaacggagacggcatcatctcacccaatgaatacatgaaagcctgtccctgcttcgatgtgaaaaaggagttctagggagtagttgtacgcaatagtaactctattctcctccttcgggaaggaggagtacccgtagggggaggtggtaggtgaatgcataatcctatcatttacaaaaaaataggtataaacattatttctcctaccacctcggtctgcgaccactcctccttcccgaagaggagaatagagatagaatcgactttttagtcaccctcagttgagatacagaactgactatcaagtagcttatcaccatactgaaatgagctaaattaaaattaccgattcgccttattcattatttatcagtcaatatcactctaaatattcaaaaagatggcccgtatttccaaacccggattagattatttcccgctcgatgtcaacttcttccaagacaggaaggtacgccgcatttccaaccgtcatcatgcggcaggaattgccgcactcacttccctgctctgcctcatctacaaagaaaagggattttacgtcgcatggaatcaagataccttgttcgacatttcgcaggaagtgtgttgcgaggaggaggagatgcaggccatcatcgacgactgcctgtccgtcggactgttcgacacctatatatataaggagtacgggattctgacttcgcaagccatccaagagcaataccacaaaatcattaccgacagccgaaggaaatacaaacttccgctggaacggttttggctcatcaaggaagaaaaggatggaacgggaaataattccgcagacataagaagcaatataaattcaaaaggtacagaagtggatgaagcggaaaacaagatagtagatgcaggagtcaacacaacaaaaacaggagtcaatatcacagctacagaagttactaaaacaaagccaggaatcggcacgacaggcacaaacatccatgcagcaggcacagacatccatgcagcaggcacaggaatcaatgctacaaaaacagtgaccgacggagcagctatgaaaattaatgctgcaaaaaaccgagaaattgcagcaacaatcccacaaacaaaacaggaaacggatacagaaatcgaaagtaaatcggaaacggatactgagattcaaagcaaaccgaaaagagagatggaaaatgatatcaaaccggaaagagaaaaagacaaagagagagaaagacaaagcaaaaccgaaaatgaatgggagaaagatagagagcagccgcccgttccgtcaaacggcgtttctcaggctgcgcctgttgctgtcaaaggtttgtctttagaaatctcgtccggaaaaagggaggaggaaaataaggaagaaagaagaaatggaggaatagatcagaagggagaagctagatataacggaacccaatacgaaagaaaccagctagaagaacccaagcataacggaacccagtacgaaagaaaccagcaggaagaacccaagcacaacggaacccagtacgaaagaaaccagcaggaagaagccccgaacgaaagcattgcttccggaggattctccgaatccctgctgcgcctcaacatggacgccatcggcatccggaacgaacaaaccgtgaaaggcatcctcgccctcgcccgacgcagaaagctgggtggtccgtgcggcaccttatggaaagtcctcagctccgaataccgctccaccctgctcaaaaagaacgagccgggcgactacatcctctgggcgctcaatcacccggcagaatttgaggacacctacaccggtatcctcaaaaagcgagttaggggaagatgaacatttttaagaggaagatgagcatttttgagcgcccacgtcatttatttctcccgccaaacgcatcataaaacaataatttatcctatctttgtgggacaaagaaaaagcctctttaccgtatgcaaagagaaacctctctttacaacctaaaagagcaacaaccaaaacaatgagcaaatttatcaatccgttcaccgactacggattcaaattaatattcggcagagaagtctccaaggatttactaatcgaatttctgaacgaccttctcgaaggtgaacgagtgataaccgacttaacgtttttgaacaacgaacagctgccggactacccggaaggacgaggcatcatctacgatgtctactgcaccacggacacgggcgaaaagataattgtcgaaatgcaaaaccgcatgcagagcaactttaaagaacgctccattttctatctctcccgtgccatcgtcaaccagggccggacggggcacgactggaaatttgaaataaaagctgtttacggagtctttctgatgaatttcatcatggacaagaacataaaactccggacagacgttattcttgcagacaaggagacaggtgaactcttctcggagaaattccggcaaatattcatcgccctccccctcttcaaaaaaagcgaagaggaatgtgaaacgaattttgaacgttggatttatatattaaataatatggaaactttaaaacgcctgccattcaaggcacgaaaagccgtcttcgaaaaactcgaagagatcgctgatgtggcttctatgtctccaaaagagagggagctatacgataatagcgtcaaagtgtaccgggattatttggtgacaatggatgcagcggaaaaggaaggaataaaaaaagggatgaaagaaggaatgaaagaaggactgaagaaaggacttgaagaaggacttgaggaaggcctgaagaaaggtcgcgaagaagccttgaacatctttcagacagccatcgacatgaaaaagcaaggaattgacaatcaactcattgccgaaaagaccggtctgcccctatcgctcatagaaagcctcaaataaaggtagaacctaagcatccgcccccctgaaaacaagccgagtacctgcccgaaaaagatgactgagatcgaaaaagaaagggaaaaggttgcgattatagtaagtgagccgggaagccaagttgcagaaagcagcacttatattctgatttacaataagataggacgaaaaaggaggaaaaagagaggctataaaatatcaataagtcttagaagaacttggtacattcgtgattgtaaacttaccatcaatatccgtgatagtaccaagagtagtgccattcaccaataccgaagcacctacaacaggcaggccatcttcctcggcggttaccacaccggtaactcgggacgtctgcgctgtcaccagacctatacccacaaaaaggaaggtcataaagaacatcaattttcttttcataaattctctcttaaatttaacctataaatagacttctagtctctaacagggtgcaaagataacactatttatatcaaaattaaaaaagtgttacgtttttaactataaagtatcatattgaaagaatttaatcagagaataaatcaaataagtaaatctaaagacgtatttagcagcatttaaacattattacctaacagaaagaaagtgttaaaaccgctattttcataaaaaaaacatcagatattcgttcgaaatggtatctttttatcattttatgccttaaatagccccaaaaacacttaacgcttcccgaaagggcaactccccaccgtaccaagttcttctaaaactttgcgcgtttcctatgtaggaatgactccgcaaactgttacgatcacacaaggcgttatcaaagtagtattaaaaagtgacgccaagtcactagacgaagtcgtagtaacggccatgggtatctcccgcgaaaagaaagcgctgggatacgccgttcaggacgtgaagtcagaccagctgacacgcgcggccaacaccgaccttgcaggagcactacaaggaaaagtttcgggtgtggacatcgctccctcttccggtatgccgggtgcatcttccaagatcacgatccgcggttcccgttcgttcacgggcgacaatacacctctgtatgtcatcgacggcatgccgatctcttccgctgccgacgtaacgactaccgacaacgctaacggcgccgcctacggtaccgactacgccaaccgttcggtggacatcgaccccaacgacatcgaaagcatcaacatcctcaaaggtcaggcagcttctgccctctacggtatgcgtgcgtcaaacggtgtcatcgtcatcaccaccaaaagcggtaaaggagtggccaaaggcaaaccgacgatcacattccgcagcaatctttcgttcgatgtcgtgtctacactgcccgaactgcaaaacgaattcggacaaggcagcggcggctcatacgacccttattccggccacagctggggaccgaaaatagccgacctcgccaacgatcctacatacggcggcaacaccgacaacgctttcacccagaaaatgggaaaacgtcagggacaatactacgtgccccaacgtgccgaagccggtcttgacccgtgggcaacgccgaaagcatacaacaacatgaaggatttcttcgacaccggcattacctggagcaacaacgtcaacgtttcccaaaatctggacaaaggaaactactctttctcgctgggtaacagccaccaggaaggcatcatcccgactaccggtatggacagatacaacgccaaaatgtctgccgaagttcagctcagccccaactggtcgactggcttcaacggtaacttcgtgacttccaagataaaaaagcagtctaccgccaactccggcgtgacggctaccatctacaacgctccggtgagctacaacatgaaaggaatcccctcgcacgtcgaaggcgacccgtacgagcagaacacgtaccgccaggcatggatcgacgacgcctactgggctgtggacaacaatctgttcaccgaacgctcgcaacgtttcttcggaaacgcattcgtgaaattcacgaccaaattcggcacggacaaccacaaactggacgtgaaataccaactcggtgacgacgcctacaccaccaactacagcgaaatctacggatacggcagtacaatggcagacaccggcgacgccatcgaataccactacagcatcaacgagctgaactcgctgctgacagcttcttaccgctgggacatcaacaaggactgggtattcgacgccctgatcggtaacgaacttgtagagaaaagaacgcaatatgccttctccgaagggatgaacttcaacttcccgggatggaaccacatcaacaatgcttctatctaccagagttccaagtcgtacaacaagaaacgtacggtaggtaactttgccaacctgtctctggcatggaaaaacatggtatacctcaacggaacaatccgtaacgacgtcgtttcaaatatgccgcgcgacaatcgttcgttcacttatccttccgtatcgctcggatttgtgttcaccgaactcgaaccgctgaaaaacaacatcctcacattcggtaagctgcgcgcatcgtacgccgaagtaggtatggcaggcgactatatgcaaagctattactacaccccgagctacggcggcggattcttcaacggcacgcccatcgcctacccgatcaacggaacgatggcatatatcccttattataaggtgtatgacccgaacctgaaaccgcagaacacgaagtcatacgaaatcggtgccgacctgacattcttcaacggactgttcactttgaactatacctactcgcgtcagaacgtaaaagaccagatcttcgaagtgcctttgtccggctctaccggctacgacagcatgatcatgaacggcggtaagattcataccaactcgcacgaacttacactgggagtgtcgccggtcaacaaccgcaacttcaagctcgacttcgctttcaacttctcaaagatcgacaactacgtagacgaacttgcaccgggtgttgaaagcatctatctcggcggattcgtcactccgcaggtgcgtgccggtatcggcgagaaattccccgtagtatacggcagcacgtacaagcgcaacaaggccggacagatcgtggtagacgcgaacggacttccgcaggtgggcgaagacgacgtgatcggccgggtttctcccgacttccgtctgggcttcaacacgaatatcgagctttacaaattccgtatcgctgccgtgttcgactggaaacaaggcggacaaatgtactgcggtactgccggtgaaatgaacttctacggtgtcaccaaagaatcgggcgaaaaacgcaagagcaacttcgtcgttcccaacaccgtgaaagaaaccggaacagacgcgcagggcaacccgacgtatgccgccaacgacatcgaagtgactaacgcacaggcttattacacccgcctgcgttctatcaacgaatcttatatctacgattcatcgttcatcaaactgcgtgagctttctgtaagctacccggtatacgccagcaaatggctaaacgtagatgtaaacgtatttgcccgcaacctcatcgtatggtccgagctgaagggattcgacccggaagcatctcagggtaacgacaacatgggaggtgccttcgagcgtttctctctgccgggaactgcaagctacggttttggtgtaaatgtaaaattctaattagctaaacgaaagaagattatgaaaagatatgataaaataaccggtgtactggctgttgccgctctgtctttgttctctgcttgctcggaggacacgatggacagaatcaacaaggaccacgaccacaccaccagtgttgcctcaagatttatcttggcagatgtaatcacctctaccgctttctccaacgccagcggtgacatcaatacatacgcctcttcgtatatcgaatacgaagtaggtgtcgacaaccagctttactacgccgaagtccgcgaaaacgaaccgtcgtcctcgtctaccttcaataactcatggaacggcatctattcttcattgaagaacgcccgcatcatcatcgaccaatgtggcgaaggaggcagagatcacggcaacgacgtcacccggggaatggccgaagtgatggccgcttacaactgcgcactgattgccgatttcttcggtgatgccccgtgcagtcaggctgcgctggtggacgaaaaaggctctccggtctatatgaccccgaaaatggatacgcaacaggaaatctatactcaaatcatcagttatctcgacgacgccatcgccaatcttcagaaagaagacttggcagacgtgaccgagcaggatttcctttatgccggcgacgcggacaaatggctgaaattcgcttacggcctgaaagcccgctacaccatgagactgatcaaccgctcaagcaacaaatcggccgattatgaaaaggtgctggactatgtaagcaaatcgttcacttcggctgacgaccaggctgcattcgacatctacgactctaacaacatcaacccgttctacggtttctacaactctcgtgccggattcggagccagtacaagcctcggcaccaagctgttggcctacaatgatccgcgtgccaaccgtgctttcttcactccgatcgtcgacaaaaaacgttcgcaggtagcagccaacgatcccagcctcgttccggctcccaacggtagtccggatcagagtacgtccaaatacggtatctctgcattcgtttacgccaaaaccgcaccgaccctgctgatgagctatcacgaactgatgttcctgaaagcagaagctctgtgccgtctgaaccgtgatgcggaagacgcgctgaaagaagcggtagtagccggcttgctgaatgcggaaaacagcataagcattgccatcaaggagttgggaagcggtttgaacaccaattccagcgaagtaatcacggaaacgtctgccggaaagtatttcgacgacgtagtgaaagcgaaatatgcagccaacccattgcaggaaacaatgattcagaagtaccttgccatgtggggtgcctccggtgaagccacggagacgtacaacgatttccgtcgtatgaagggactgaacgaaaacttcatcacgctgaccaacccgaacaattccagcaaattcccgctgcgctacccatacggaaacagcgacacagctgccaacccggaagtgaaagccgcttacggcaacggtgactacgtatactccgaacccgtttggtgggcaggcggaagccgataaaaatcgctcttaaaatctctcaaaggagagactttacatagagtcgtttctgaactctaacaaattaacggaaacgaacagaaataggccgaccgtgaggtccgcctattttacttttacagccttctgccgaaagtgtcgggcagaggcattccagacaatacacccggattgatacagtaatatccggattgacatagaaacgtccggacacagctgacggggataatgtggattttcatatagtaaaaatccatattatccccgtcagctatttgttaatatcacaaatacaaaacaggaaaaaacacccgaattgttataccgtttttctactcagcgataccgttttgccggataaagatcatgtttgccggagcaaggaccggtttaacaaacaaaaaagatcagtctaccggacaaaaaaagagatcggtttaccagaccagttcggggaaatacttcgtcagcgtattgcgcagaatcgacagtgtgatcggtttcaccagcacttcgctcgctcccgcgttcatcgcattctccttgtcagagctgaaagcgtaggcggtctgcatgataatagggatttccttgttttctccgcggatgattttcgtagcatccagtccgttcatcacaggcattttgatgtccatcaggatcgctttggcctcgttgccgtattccttgaacagtgccacgatttcttcgccattcttggcccactgtatatcacatttctttccgatgattgctttgatcagtttgaagttgctgtcgtcgtcctcagccactaagataagaggtctgaattcatttgtttgtccgccttccatatcgtttctatattatttttaaaattattctctaaaattactttttagtcaacatatttcagttaataatgcttttcagcccgcaagttataaaaaagattgatatatttcgctatctttgcgcctcaaattataaagaattgtatgatttcgatagacggactagccgtagagtttagcggcactaccctatttagtgatatttctttcgttattaatgaaaaagaccgcatcgccctgatgggaaaaaacggagcgggaaaaagtaccttactcaagattctggcaggagtcagacagcctacccgtggcaaggtttcggcccccaaggattgcgtagtagcctatctcccacagcatttgatgacggaagacggcagaaccgtgtttgccgaaacggcacaggctttcgcgcatctgcacgagatggaagcacggatcgacgcactgaacaaggagctggaaacacggacggattacgaaagtgacagttacatggcactgatcgaggaagtgtccgccctcagcgaaaaattttactccatcgacgcaaccaattacgaagaggatgtagagaaatcattactcggactcggattcacacgcgaagattttcaacgtcagacgagcgacttcagcggaggctggcgcatgcgcatcgagctcgccaaactgctgctgcaaaaaccggacgtactcctgcttgacgaaccgaccaaccacctcgacatcgaatcgatccaatggctggaagattttctgatcaataacggcaaagcggtcatcgtgatcagccacgaccgcaaattcgtggacaacatcaccacccgcaccattgaagtaacgatggggcgcatctacgactataaagtaaactactcccaatacctgcaactgcgcaaggaacgccgcgaacagcaacagaaggcttatgacgagcaacagaagttcatcgccgaaacggaagccttcatcgaacgcttcaaggggacgtactcgaagactttgcaggtgcagagccgtgtcaagatgctggaaaagctggaattgctggaagtagacgaggaagatacttcggcactgcggctgaaattcccgccttcgccccgttcgggcagttatcccgtcacgatggaaggtgtcggaaagacgtacggcgatcatgtcgtgttccgcaacgccaacctgacaattgaacgtggcgacaaggtggctttcgtaggcaagaacggtgaaggtaaatcgacgctggtgaaatgtatcatgaacgaaatcgaccatgacggcacgctgacgctgggacataacgtgcaaatcggatatttcgcgcagaatcaagcctcgctgatggacgaaaacctcacggttttccagacgattgacgacgtggcaaaaggagaaatccgcaacaagatacgcgacttgctgggcgccttcatgttcggcgggccggaagagtctatgaagaaagtgaaagtgctctcgggtggcgaacgtacccgtctggcaatgatcaagctcctgctggaaccggtcaacctcctgattctggacgagccgaccaaccacctcgacatgaaaaccaaagatatcctcaagcaagcgctgatggatttcgacggcaccctgatcgtcgtttcgcacgaccgtgacttccttgacggactggtgaccaaggtctacgagttcggcaataagaaggtgacggagcatctttgcggcatctacgaattcctcgaaaagaagaaaatggattcgttgcaggaactggaaaagaaataataaacaataaaaagacattatctgctttaggtgaaagaaaaagtatttgtatatttgtcacataatatctgaaacagataatttaaaatggatgaaacgaggcagttatacattataagcggatgcaacggagctggtaaaacaacagcttcttatactgtactgcccgaaatattattgtgcaaagaatttgtcaatgcagacgaaatagccaaaggactatcgcctttcaatccggaaagcatggctatcgaagccggacgtctgatgttgaaacgtattgacgaactattggctacaagaaccagtttctccatcgaaacgacattagcgactcgctcgtacacacggctcatcacaagagcacagagtgccggatacaaagtaagcctgatctatttttggctaaactctccggaacttgctgtcaaccgtgtattgcaacgggtcaacgaaggcgggcataacgtgcccattgatacaatctaccgccgctatcaggcaggcataaacaacctgttccgaatatatgcgccacgtgtagactattggctattagcagataacagtgtttctccccgagtgattgtagccgaaggctgccagcaaggtgaggaccggatatacgaacttgaactttttaatcgcatcaagagttatgtcaaataatgaaatgcaagaattgagtgataaactgcggcgcgggctccaactggccgaacaacggctactggaaagaaatgcccgtcacggaaaactcctcagtcaagggacgcccgatggaaaagtgatttacgtctccgccacagaattgctcgaacgcttgcaggagcaagaaaaagagaaaagtaaagagtcggaaaaagaataattgaagttttataataaagcaacaaccggagctctataataaagtaaaaagatattggaagttttacaaaattagaaagctctatataaataaaggatgaaagggaagaaacgattcatagtaacgatgctattctttatcaacattatcatgttggtagccgccgttattccccatcaccaccaccccaacgggatgatctgcatgaagcaggaccaaccggtagagcagcaatgccccaaccaccatcatcaccccgcaagcgattcatgttgcagcagcgaatgcatgacccgcttccactctcccatcccctccgtgcacacggacagcggaccgaattacgtattcgtcgccaccctgtttacggatatgatcatcgaacatttattacgaccgcaggaaagacgagtcaaaaattactacatctatcgtgaatccctgcacggtacgaaaatacctcgtacctcctcccttcgggcccctccctactctgtttttgcgtaatgacgtaaatgcaagcaagttgcatctgcgttactctatctttgtagcgtacaaaaacagtaaaacttagtaggaaaacaacatttatgaagaaacttatctttataggagtcatgggattattcgtcctgggctcttgcaacagtaaaaatactggtcatgaaggacatgaccacgagaccgtcacacacaatcatgatgaacacgaaggacatgaccacgaagcggaaggtcatgaccacgaagccgaaggacatgaccacgaagccgaaggagccgaccattcacacgaaggtgaatgcagcggaggacacgatcacggcaaagttgccaccagcgaacccgccggcgagcacagcgatgaaatcatcctcccgaaagcgaaagctgacgctgccggtgtaaaggtaaatgctatcacaccggcccccttccagcaagtcatcaagacaagcggacaggtactcgctgcccaaggcgacgaatcggtggctgtagccacggtggccggagtcgtttctttccgcggcaaggtgacggaaggaatgagcgtcggtcgcggcactccgctggtgactatttcttcgcacaacatcaccgacggtgaccccgtacaacgtgcccgaatcgcttacgaagtatccaaaaaggaatacgaacgaatgaagtcgctcgtcaaaaacaagattgtgtccgacaaggatttcgcacaggcggagcagaactacgaaaacgcacgtatcagctacgaagcgctcgccaaaaaccactcggccatcggtcagaatatcaccgcgcccattgccggatacgtgaaaagtattctggtcaatgagggagactacgtaaccatcggtcagccactggtcagcgtgacgcagaaccgccggcttttcctccgtgccgaagtatcggaaaaatactacccatatctccgcacaatcagttccgccaatttccggacaccttataataatgaggtctacgaactgaatgaactgagcggcagactgctttccttcgggaaaacttccggagacaactctttctacgtacccgtcaccttcgaatttgacaataaaggagaagtgattccggggtcattcgtcgaagtttatctgctttcctcccaactggaaaacgtgatatccgtgccccgcaccgccctgacggaagagcaaggcatcttcttcgtctacctgcaacttgatgaagaaggctacaagaaacaggaagtgaccctcggcgccgacaatggcaaaagtgtacaaatcctgaccggaatcaaacccggagaccgtgtagtgaccgaaggcgcataccaagttcgcctggcaagcgcaagcaacgccatccctgcccacagtcatgagcactagcggcaaagcgccgcatccaagttcccttgcggcacacacagaactcatttatagttacgcaagtttatcccctgtccggcacttctcaaaagtaaaccgggaggaaccagacttaatcaatgaaatatcatgctaaataaaatcatacattactccctgcacaaccgactggttgtgctctgcgcggccatcctcctgcttatcgcggggacttacaccgccatgcatacggaagtagacgtgtttcccgacctgaacgccccgacagtggtcatcatgaccgaagccaacggtatggcagccgaggaagtggaacagctcgtcaccttccccgtcgaaacagccgtaaacggggctaccggtgtgcgccgtgtccgttcttcttcgaccaacggtttctccgttgtctgggtagaattcgactggggcacagatatatacctcgcccgtcagatcgtcagcgaaaagctcgccgtagtcagcgagtcacttcccgtcaacgtgggcaagccgactctcggcccccaatcgtccatcttgggcgaaatgctcatcgtcggtctgaccgccgactccacctccatgctcgatctgcggacgattgccgactggacgatccgcccgcgcctgctctccaccggaggcgtggcacaggtggcagtgctcggaggagacatcaaggaatatcagattcagttggaccccgaacggatgcgccactacggcgtatcgatgggagaagtgatggccgtcacccaagacatgaacctaaacgccaacggcggcgtactttacgaatttggcaatgaatatatcgtgcgcggagtactctctacccccaaagtggaagaactcggcaaagcggtagtgaaaacggtgaacaactttccggtgacgctggaagacatcgccgacgtgaaaataggtcccaaagccccgaaactgggcacagcctcggagcgtggcaaaccggccgtactcatgaccgtcaccaaacagcccgccaccagcacgctggaactgacggacaaattggaggcctctctgcaagacttacagaagaatttgcctgcggacgtcaaagtctccacggatattttccgccagagccgctttatcgaaagctctatcggcaacgtgaaaaagtctctttttgaaggaggaatctttgtcgtcatcgtacttttcctgtttttggccaatgtacgcactacgctgatttcccttgtcacgctgccgctttcactactcgtctccatcctcacgcttcactacatggggctgactatcaacacgatgagtctgggaggtatggcgattgccatcggttcgctggtcgacgacgccattgtcgacgtggaaaatgtatacaagcgactgcgggagaaccgtctgaaagcggaagccgaacgcctcagcacgctcgaagtggtattcaacgcttcgaaggaagtgcgaatgccgattcttaattcaacgctgatcattgtcgtcagctttgtgccgctgttcttcctgagtggaatggaaggacgtatgctggtaccgctgggtatcgctttcatcgtggcgctgttcgcttccacggtcgttgccctcacgctgactccggtgctctgctcttacctgctgggcagcaacaagacgaacaaggaactgaaagaatccttccttgcccgctggatgaaaggcatttacgaaaaggcgctgacatgggtgctggctcacaaacgggtgacactcggcagcaccatcgtccttttcctgatcgccttaggggtattctttacgctcgggcgcagcttccttccttcgttcaatgaaggctcgttcaccatcaatatcagttcgctgccgggcatatctctggaagaaagcaacaagatgggacaccgtgccgaagaattgctgctgacaatccccgaaatacaaaccgtagcccgcaaaacgggacgtgccgaactggatgaacacgcgctcggcgtaaacgtttcggaaatcgaggcaccgtttgaactgaaagaccgcccgcgcagcgaactcgtcgccgaagtgcgcgagaaactcggaacgatcaccggagcaaacatcgaaatcggtcagcccatcagccaccgcatcgacgcgatgttgtccggtacgaaggcaaatatcgccatcaaactcttcggagacgacctgaacaagatgttctcgctgggaaaccagatcaagggagctatcagcgacattccgggaattgccgacctcaacgtggagcagcaaatcgaacgcccgcagctgaagatacagcccaaacgggaaatgctggcgaaattcggcatcaccctgccggaattttccgaatacgtgaatgtggcgctggcaggaaaagtgatttcgcaagtgtacgagcagggcaagagcttcgacctcatcgtcaaagtgaaggacgacgcacgcgacgaaatggagaaaatccgcaacctcatgatcgacaccaacgacggacgcaaagttcctctgaactacgtggcggaagtggtttcctcaatgggcccgaacacgatcaaccgcgaaaatgtaaaacggaaaatcgttatctccgccaacgttgccgaccgtgacctgcgcagtgttgtaaatgatattcagaagcaggtagacgccactatccagttgcccgaaggctaccacatcgagtatggcggacagttcgaaagcgaacaggctgccagccgtgtattggcgctgacatctttcatgagtattgtcattattttcctgttgctttaccacgagttccgcagcgtcaaggagtccggcgtgatcttgctgaacctgcctctggcattgatcggcggcgtttttgcccttgtcatcacgaccggcgaagtaagcattccggcaattatcggtttcatctcgctgttcggtatcgcgacccgtaacggtatgttgctcatcagccactacaaccacttgcagcaagtggaggggctgaacgtgtacgacagcgtgatacaaggctctctcgaccgtctgaatccgattctgatgacggctctctcctctgcgctggcgctgattccgctggctctgggcggtgatctgccgggcaacgagattcaaagtccgatggccaaagtgattttgggcggacttttaacatctactttcctgaacggtttcatcgttccgattgtttatctgatgatgcatcgccagcgtagcgccggagcaaattctccatgcggcgtaccggcggaacaggcataattatcagttaaatatagctactatgtatatagaaacaaataaaaaaagtatgaaacgaatcatcatcataggctctttggtaagctgcgcacttctcgccctcacgggcgaagtgcaggcccaaaacggcatcgaacaggttttgaagaatatcgaagccaacaataaggagttgcaggcgaacgcccagctcatcacctcgcaaaagctggaagccaaaacggacaataacctgccggacccgactttatcatacgcccacctctggggagcgaaagataaaaacgaaacgatcggcgaacttgtggtgtcacaaagtttcgactttccgagcctgtatgccacccgcaacaagctgaatcgtctgaaagcaggtgcttttgacagtcaggcggatgtcttccgccaagagaaattgttgctcgccaaagaagtgtgtctggacattatcatgctgcgccagcaaaaacacatcttggaggaacggctgcgcaacgcggaagaacttgccaaaatgtacgccaagcgcctccaaaccggagacgcgaacgccctcgaaacgaataaaatcaatctggaactgctgaatgtcaagacagaaacttcgctgaacgagacagcactgcgtaataagttgcaggaactgaacacgttaaacggcaatatccccgtagtgttcgaagaaagcacgtatcccgcaacgcctttccctgccgactatcagatactgaaatcggaagtgctctccaccgaccgcacattaatggcattcaacaacgaaagcctcgttgcccgcaagcagatcgccgtcaacaagtcgcaatggctgccgaaactggaactcggctaccgccggaacaccgaaacgggaacgcctttcaacggagtagtagtgggattctccttcccgcttttcgagaaccgcaacaaggtgaaaatagccaaagcgcaagcgctgaacatcgacttgcagaaagacaacgccaccctgcaagtggaatccgaactggcacagctctatcgggaggccaaaacgctgcacacctctatggaggaatacaggaaaacttttcaggcgcaacaagacctcgcactgctgaaacaggctctgacaggcggacagatcagcatgatcgagtattttgtcgaggtatccgtcatttatcaaagtcatcagaattacctccaactggagaatcaatatcagaaggcaatggcacgaatttataagagcaagctataaattcccgctttatttcgcccgattattgaataaataaaaagaatgcattacatttggggactgtaaaaaaacactaaactattatgaaaactaaaaccctctcttacacccccatcttgttttgcattcttattttatggagtgcctgtaaagacgatgccgatgcccccctgcggttttacgacagcaaatacgaagtgcccatgggaggaagacgctacctcggaatcgaaagcggaaacggagactactctttggaaatcggaaatccccgcatcgcaagtgccggaatcgaaagcggctggagcggagttcccgccggacgaatgatttacatatccggaattctcaccggaagcacgtatctgaaagtgacagacaacgccacacaggaaacgctcactctgcccattaaagtggtggactactacgaagatctcaatctgatacacggctcgtcctccctgcgtcccaatggggacgagaacctactgccgggtgttgacgacattttccttgtcagcaacgctgcccgtgacgcttatttcttcaaacaaggacaacgaaccgctttttcatcgggactcgaactgatcaccaaaggaacttatgcactgaagcaagaggacgagaacaaagccacactgacccttactttctcattggatgcctcaccggctacggaacaccatttcaccgtatggggaaacacgtacctgcttcaccggctggacaagaacttatatctgaactggggcacgccgcccattggagaaacacggacatcacctgccccgcctccggcctacacactggaagaaataacggaaggagcagaaccgggaacaggcagacaggtcggtttcattctgaattataaggaaatacccactggaatacttccctaaattatggatgataaattagccgagctatcaagataagcattctatccgttgtccgtttctttcggaaataatctttacagcgtacgtatctcctccggcaaatacccgctgcggatacgccactcctgcggataaagattattggcacgattccctatattcttcacaaatccgagaggaatattccggtaagtaagcaagatataaccacgaggggctgtttccgacaaggtaatagcctcttttcgtaaataagcgatagcctgttcataactcacctcttccgtatcaaaagcatcctgccgcaagagcgtagcgctcattgccaacgcatgagcgggaatcaaatctctccctttcacttcaccagtcagaacgcctgcctgtatcactttcagatgctgtttcatggcagccagttcatcggtatatcgttgcggaaatgcgacgatgcccgcgccttccgcagacaggatgtatttttcaacattttcctgcttcagccagttcagtgccatccccatgtgttctttggaaacgggagaagcagctgctccacctttcttatcttttttcttggacgactttgcttttgagaatgaataggttgccggttcatcttccgaatccggtttgcgaagtgccgccaaaaagaatccttcgccttttgtcttatgaggaagaaaatgacagacagacaaacttccctgagactcgtcctctccatcgagtaaattccctgttatattccactcgttccgcacctccagaggcaagagctccgcaccgaattcctgctgaatccagcagacgttctcttcatcttctttgctattataggtacacgtactatatattaatatgccgcccggtttcagacagggccaaatatccgcaataatccgccgctgacgctgccaacagatctctacattctccgggctccattcctccacagccacggggtctttacgaaacattccctcgcccgaacaaggcacatcggtcagaatgacatcgaagaaagacggaagtgccaagaaatcagccggatcattgttggtaaccaccacatccggatgcccccacttcgtcagattctccgccagcacctgtgaacggttccggatcacttcattcgccaccagcagactcccttccggaagcacgctgcgcgcatgggttgattttcctccgggcgccgcacaaagatcgagcatcaccaccggagactcgacatactgccgcagcacctgctccacaaacatggacgaagcctcctgaacatagtagcaaccggcatgaaacaacgggtcgaacgtaaaagtcagacgctcgtcaagatagtagccgtcggatgcccagggaactttgttgaaggaaaaatgagcagaactgtctgtcagcgaacttaatccttcctccttcattctcaatttattgatccgaatgctgacgggaggctcctgctgcaaggcggcagccagtttttcatattcttcattgcccagtaaggcacgggtatagtcgataaaagaagcgggtaaattcatttttcatttattaattcctgcaaatatcaaaaatatttcgtctctttgcaactttctgacatacgaactacgtctaacagacaaagaaacaaataaaagaattaatatatgaaacggattttaattgctttactggtcatgatgaccattttctctctggcaaacgcccagaaacaaacgactattgtgaacgactctaccggaaacgtaaaagtgaccgtaacgaaagggaaaggcaaggatgccaaggttaatgtcggcaacacggccgtcactgtgatcggcatcgatgacgaagacgccgacacgacaagtgtagatacgggcaaagtgagtagctcctcgcgcggccctcacggaaaagcgagcttcaccatcagctctgacgacgatgacttcccgttcaataatttcggagatgcagtcggaggaggtattctggtagccatcatcagcatcattgccatattcggaatgccggtattcatcatatttgtagtcttcttcttccgctacaagaaccggaaagcacgctaccgtcttgccgaacaggctctcgcagccggccagcctcttccggaagaattcatacgggagaacaaatcgacagaccaacgtacacaaggaatcaaaaatacctttacaggcatcgggctcttcatattcctctgggccatcaccggtgaattcggaattggcgctatcggactgctcgtcatgtttatgggactgggacaatggctgatcggctacaagcaacatgccaacgaggaaaccaagaacagagaaaccgccatcagaagcaacgacatcatcatctcggagaagaacgacgaagagaagaacgaagaaaatagatgagccaactcaacgatatatcgctagtcgcacaggtcgtggtgttcaagaacaccagggccttcgaccagttggtacaaaaataccagtcgcctgtcagacgcttcttcctgcatctgacttgcggtgacagcgaattgagtgacgacttggcacaggatacattcatcaaggcatataccaatctggcctcgttccgtaacttgtcgagtttctccacatggctataccgtattgcttataatattttttatgattatattcgcagccggaaggagatggcagacctggataccagggaagtagacgccgtcaactgcaccgaacaagcgaacatagggcagacaatggatgtttatcagtcactcaaatcgctgaaggaagtggaacgaacctgcatcacgttgttttacatggaagatgtaagcatcgacaagattgcaggaataacgggaataccggcaggaacggtgaaaagccacctgtcgcgtggaaaagaaaaattagcaacgtatttaaaaagaaacggttatgacggaaatagataatgataaacttctgaaagatttcttcgcagaaaacaagcgggaaatagccgacaacggattcagccgccgcgtcatgcaccacttgcccaaccgcagtaaccggttggcacgcctctggactgtattcgtaatggcagtaggagccacgctcttcgtcaccctgggcggactggaagccgtatgggaaacactgaaagatgtactcatcggcatgatcaaccacggcgcaaccagcctcgatccgaaatcaatcatcattgcaacggtcgtcctactgttcatggccggacggaaagtagtatcaatggcataacaatgcttgtcacactctgtgccaaggacttggcacagttgtgacaccgcactggcacagcagtgacaagccgttggcacaagtgtgacaacggcagggaacacagcagatcagatgtatcgaacgaatataattccccagatcaagagattcttgttcatttcttctgttaaagtataataaatttgctctcctctcccgatagctccaaacatagatgttgtatctttgttactttgtaaactaaaatagcgagaagagttttgaaactacgtatatttcttttatttctgtttctgtctttattccgtgctcaggcagatgtcatcgacagtttgatgacgcattccagagactccatagctctgacaagtgactcccttgtattacgtttcttatcggagtcagggattcctatatccgacaataacaaggttaggttactgaaaagcggacgagaaaaattcattgatttattcagcgccatccgcgacgccaaacaccacattcatctggaatacttcaatttccgcaatgactctatagccaatgcgcttttcgatctgctggccgaaaaggtgaaagaaggcgtggaagtacgggccatgtttgatgcattcggcaactggtcgaacaataaaccgctcaagaagagacatctcaaaaaaatacgggagcagggaatcgagattgtcaagttcgacccgttcacctttccctacatcaatcatgcggcacaccgtgatcaccgcaaaatagccgtcatcgacggcgaagtcgcctatacgggaggaatgaacatcgccgactactacatcaacggactccccaaaatcggcacatggcgtgatatgcacatgagaatagaaggcgatgccgtcaatgacctgcaagaaatatttcttaccatatggaacaaggagactaaacaaaacattggcggcgaagcatacttccccaagcacaaggagcagtcggacaccaccaatatagtcgtcgccatcgtagaccgcacaccgaagaaaaacagccgtatgctcagtcatgcttatgccatgtcgatctattcggcacagaaaaatgtgcacattgtcaacccatattttgtgcccacatcctccatcaacaaggcgcttcaacgcaccatcgaacggggtgtggatgtcacgattatggtttcttccgcctccgatattccgtttactccggacgccgccctctacaaacttcacaaactgatgaaaaggggagccaccgtctatatgtacaatggcggtttccatcattccaaaatcatgatggtcgacgatattttctgcacggtaggcaccgcaaacctgaacagccgcagcctccggtacgactacgagacgaacgctttcatcttcaacaaggaaattacaggcgaactgaacgaaatgtttcagaacgatatagagcactgtacgcagctgacaccggaattctggaaaaagcgctcaccgtggaagaagttcgtcggatggtttgccaatttattcacgccatttttgtaattttgcatcgcaccaacttattggaaaattattcgctatgaaacaatatttagatttactcaatcgcgtattaactgaaggaactgagaaaagtgaccgtacaggaaccggaacgatcagtgtgttcgggcatcagatgcgtttcaacctcgacgagggtttcccgtgtctgaccaccaaaaagctgcatctgaaatcaatcatctacgagttactctggtttctgcaaggtgatacgaacgcgaaatatctgcaagaacacggtgtacgcatctggaacgaatgggcggacgaaaatggtgatttaggtcatatctatggctatcagtggcgttcgtggcccgactacgacggcggattcatcgaccagatcagcgaagcggtagagacgatcaagcacaatcccgactcccgacgtatcattgtcagcgcctggaatgtagccgatttaaagaatatgaatctgcctccctgccatgccttcttccagttttacgtggcagacggccggctgagcctgcaactttaccagcgcagcgcggatatatttctcggagtcccgttcaatatcgcatcgtatgcactgctgctacaaatgatggcgcaggtgacaggactgaaagcgggtgaatttatccatacacttggcgatgcccatatctatctgaaccacttggatcaagtcaaattgcagcttagccgcgaaccacgcgcattgcctcaaatgaaaattaatccggatgtgaagagtatctatgacttccagttcgaagacttcgaactggtgaactacgacccgcatccacatattgccggaatagtagcggtataaaaccatgagtaaaatatcaattattgccgccgtagaccgccgaatggcgatcggctttcagaataaactgcttttctggttgcccaacgatttgaaacgcttcaaggcattgactaccggaaacaccatcataatgggaagaaaaaccttcgaatcgctgccgaaaggtgcgctgcccaatcgcagaaacgttgtattatccacccgtccggatacggtatgtcccggtgcggaagtcttcccgtcgctggaagtcgccctgcaaagctgcaaggaagatgagcacgtctatataataggtggcgcaagcgtctaccgacaggcacttcctcttgccgacgaactttgtctgacggaaataaacgacgttgctcctgaagccgacgccttctttccggaagtatctccggctcaatggcacgaaaaaagcagagaagctcatcctgtggatgagaaacatctctgcccgtatgcttttgtagattacgtgaaacagtaagctattttattctgtacgattaatcttcgtcttcaatgtcgaccataatcggcatctgccgctttatggcttcatggaaagagatcaatgtctccgtacgcgccaaccccagaggttgcaatttatcatgtatgatactcagcaaatggtgattgttcttagcgtaaatcttgataaacatatcatatttaccagtagtgaaatgacattctactacttccggaatagcttccaaagctcttgttaccgaatcaaaggattccggatctttcagatatataccaatataagcacaagtttcatatcctatcttctcaggatcgatcacatattccgatcctttcaatattcccagattagtcaacttctgaatgcgctggtggatagccgccccggaaacgttacacgctcttgctacttccaaaaaaggaatacgcgcgttccctgctattaatttcagaatttgctcatctaaagcatctaattgatgatgtcccatttttgaatcaaattgttttaatcaatgaatctttcatgcaaagttagctatttttcggcaacaaatactatgatttattacttttatttgcaaatatcgaataagtcaacaatagtttgtacctttgtaaaaaacataaatatactatttatatgaaacaaatttgcagtattcttctttttttcctgatttcggcaggaagttatgcgcaaaactttgcagattattttcagaataagacgttacgggtggattatatcttcaccggaaacaataagcagcaagcgatctatctggacgagctatctcagcttccctcctgggcaggtcgtgaacatcatttgtccgaacttccactcgaaggcaatgggcagatcatcgtcagagatctcgccacccgacagtgtatctacaagacttccttttcttctctgtttcaggagtggctgtccaccgatgaagccaaggaaacagccaaaggcttcgaaaatacattcttgcttccctaccccaaacagccggcagagatagaaatcgtgctgttctctccccgcaaggaagtgatgaccagcttcaagcacattgtccgtccggacgatatcttgattcataaacggggaacatcacacgtcactccacaccggtatatgcttcaaagcggtaacgaaaaagagtgcatagatgtcgctatcctggcagaaggctacacggaaaaggaaatggacttattctatcaggatgcacagaaagcctgcgaaagcctgttttcacacgaaccgttccggtcgatgaaaaataagttcaacgtagtggctgtagcgagtccgtcgattgacagcggagtcagtgttccccgcgaaaatcaatggaaacatacggctgttcattctcatttcgatactttttactcggaccgttatctgactacaagtcgggtgaaggccatccacaacgctttggccggcattccttatgagcatattattatccttgccaatacggatgtgtatggaggcggaggaatttacaactcatatacgctgactaccgctcatcatccgatgttcaagcctgtagtggtccatgaattcggacatagcttcggaggcttggcggatgagtatttttatgatgacgatgtaatgacggacacgtatccgctggatgtagagccgtgggaacagaacatcagtacacgagtaaattttgcctcaaaatgggaagatatgcttgcaccgaatacgcctgtccccacacctgtagcacaacatcaaaactatccggtaggtgtatatgaaggcggcggttactcagccaaaggtatttatcggccggcattcaattgtcgcatgaaaacaaacgaatatcctgagttctgcccggtatgccagcgtgctatccagcggattattgagttctatgtaccttaactaaaggcagtaacatctcatagtatcatataactgatatattcacccgataaaagtatacacatttgatataacatttggtatagtaatatccggtacaacaacaaaaacaatattgtcaaacttaaaacccaaaccgtatgatcagatttcaaccgatcaccacatcggacgtacaacattacaaatttatggaagagcttctcgtcgaatcgtttccacctgaagaatatcgcgaactggaacatcttcgtgaatatacagaccggataggcaacttccataataatatcatttttgacgatgacctgcccattggctttattacatattgggatttcgacggattctattacgtagaacacttcgctaccaatccggcattgcgcaacggaggctacggaaaacgcacattagagcatttatgtgagttcctgaaacgccccattgtattggaagtagaacgtccggtagaggagatggccaaacgccgtatcaacttttaccaacggcacggatttacactgtgggaaaaagactattaccagccgccgtataaagaaggagacgatttcctgcctatgtatctcatggtacacggcaacctggatgcagaaaaggattatgaagggataagacataaactccatacaatcgtttacggagtcaaggaataaagaaacaaaagaatcgtaaaaaacatacttcagatagattttagatcatatacggcaggcgaagttcagacataaagtctgcctctgccggagaataataaacagagaggctaaaaaagaagctaaaaagaaagggcgtccaattgcttggacgcccttctctatatatcaaattaactaattatttctcaccacgtttagtagaagaatagttaatcttcaaagcgtaagattttctaagggcattcttcacgtctgtgataatacccattttagtcttttggtctactttcagagacacagtcatcttagcttggtcaccctcattcatacttgcacgttcctggaaaatgaagtcttgtacttcgccaacttcagcatagctgtcgttgagctgaatacgactttcagtacccattttcgcacgatattcctgagtcggttcacccacataaatgaatgttaccagcgatttcttctccagtttttcgagttcagtacctaccggaagtgtaaactgtacctttaatgttacctcgcgcattgttgttacaatcataaagaagaacaacaaagtaaagataaggtcaggcaacgaagaagtattcaatgccggcatttcacgtttaccagttttattaaattttcccattacttacttccttttttctccgtattttttaggttctgcctcagaaattctctgcggatagatttcacgaattgctttttgctgttcgtcgttcaattccgcataaggtctttgccatttctgaagggccagttcatctctcaattcattgtatgcagcaacaagttcgttctgcacgctgatatatgcctgataagaagaaccacggtcattctgcaaagaaattacatgcttgtcgttaacgagagtcgtaccgaaaaactccacattcttctgtgtcttttcaggcatgtgctctgcattgccggcattagcaataaattctttagctttttcccttagttgctcaacaccgatataatcattaccgcacatcaaagcatcatccttattcaggtatacctgcaaaatgttacgttctttgatcttatccgtattctgttgatcttgatcttcgggtggtggaggcaaaagtcttgccaaaccacggtccgtatccattgatgttgtaatcaaaaagaagatcagcaacaagaaagcgatatccgccgtagaacttgagttaatatcaggaacttttctttttcctcttgccattgtaattacttattaaattgagtatcctcaattgattatgatatttttttctttatgccacttgcgatgattgcaacgattgttacaaacaacaggatgtagatggaataaaggaacatatcagttaatttcagccagaaaggaacgttgtcagtaccgtcataacctgggatattcatcggtgttccatcaccagcagcccaagcaatcactaaaacaacaaccaaaagaaccaaaccaagcaatgacttaattgcatttgcagggctatctttcaaagctgctccaaattggaatacagcagcaactactgtagcagcaacagccaaaccaaataacccataaatgagcatcagtaaggcatttgtgtttgccggttgccacatttcaggatctactcccgcaatgacatctgctccttgagcatcaccacccaggtagaaaagccccaggacaatgaggatgatggcaaacatcgcatacagtgcgtaatacgatactttatatgataacttactcatttcgaattattttttgtatttcagatcatatttgattaccatgtcaagcaaagagatagaagagtcttccatttcgcttgtaagagcttcaatcttagcaagtacgtagttgtagaatacctgaagaatcaaagcaacgatcaaaccgaaaatagttgtaatcaaggcaactttcataccacctgcaacaaccgtcggagagatatcacctacctgctggatcttatcaaatgcctgcaccataccgattacagtacccaagaatccgagtgacggagccatagcgataaacagtgtgatccaagaacatcctttttcaaggtaaccagcctgtacaccaccgtaagatactactgacttctcaactacatcgataccttggtcgattctcatcaaaccctggtagtagatagaagcaacaggacctctggtgttacgtgcgatgtctttagcagcttcaacatcacctttttccaaagcagcttcgatagatgccatgaatttttttgtgttgatttcagccaagctcaaatagatgatacgttcgatacagaaagccaaaccgattaccaaagcaatagcaaccaaactcatgaaagatgcagtaccttcaatgaatttaactttgatttctttgtgaataccaccttcttctgcagcaggagcagcggccggagcagcttgagcagcagcaggagcagcttgttgttcagtttgttctgctgcaggagcgtcttgagcctgagcaagttgaattgagccaaatgtaaaggccccaatcacagcaacaattgcaaataactttttcattgtgtgtctaatttttaagattaattaattgattattatttattgtatttacttcacgtttcaacttttgttctgcggagagacggggattcgaaccccggatacacttttggcgtatacacgctttccaggcgtgcctcttcaaccactcgagcacctctccttatgagttttccgcattttcagctacaaatgtatccttttttttcttttcctaaagcattatcccttttttatcttaaataaatactgcaaattaatataatttaaaacctttggaaccttatttgaccattccgaacacttttagcgcattttcggaagtggcttgtgaaaggtgctccggggtggtccgataaatttctaccagtttcaggaacgtatcatgcacattcgcactttcattcctcttcccccgattgggggccggggtcagatacggtgagtccgtttcgagcacaatccgctccaaaggcactgtcagcaaagtatccggcagtgaggactttttaaatgtgaccactccattgattcccaacatgaaaccgccaaattcaagcaaccgggccgcttcttcggcatttccggtgaaactatgaaaaataccggtcaaagcagtgtttttatagggctccattaccttatatatatagtcgaatgcctcccgcgaatgaaccacgatgggcaatttatattcgagcgcccattctatctgtttctcaaaaacgtacagttgttcgttcagaaaggttttatcccaatacaaatcaagcccaatttcgccaatggctacaaagttattgggtgcttccagacgctcccggacgattgacagttcctgacggtatgactcgttcaccgaggtaggatgcagtccgatcatcggataacagaaatccggataatccgcgcaaaccgacagcatgggttcaatcgtcgtactgtcaatgttgggcatataaatacgcgaaacacctgcctgacgtgcacgttccatcacctgcggcaggtcatcggaaaattcttctaaaaaaagatgggaatgagtatctattaacatgacaattcgctttcttcttttactttttcgttggagcggtagtaatataccagcccatagtcacgacatttttccaaccgggcttcattggggttcacttcctggaattttgtttctacctgattccagatatccagaatcagttcatctgcccggtcacgcatcgaagccagctcatccagactccggttggtggcggactggtaactcttctgacgttcgtagctatccagaaaaatatcataatgcacttttacgcgcgcaatagtcgggttataaatggggattcccccttgtgaggttctccgctgctctccttcaatgatctttctcccccactctaccaaagctgcttcgcttaataaatccggtaccacattcgcttccggaagatcataaagttctttatgcaccgatttgatttcatcgcgaagcaccgcgaggttgagtacttgaataaaatgggatatatacagccgtgccatccgcacatttgcctgatgcttgcgactggctctcgactggttgtcataacattgggtatagtaaatctgcgcagcttcaaacttcagcagaaaattacgggcttcgaataatgttttcagtgagatagccaagtcccgcacattatacacgtcacccttctcgaccgctgctttcagcgcccgtactctggcttgatccgtatttggcaatcgtctgtaaggcatttcccaccaactttactacatttcccgatacatcagtaatttcactaaattcttaagttctttcttcttctcttctgcaactgcaactgcttcaagactctccatagccagcgtataatattcgcgcattttgttttcacaaacgctgcggatagtcaactgattataaatctccgtcactgccgctatcttttctgccggctgacagttgtctgcattcagccagcgattcagttcttccagctgttctccgtttgcacgttccagtgctttgatcagcatatatgtcttcttattgcaaaggatgtctccaccgattttctttccgaacacttccggatcgccataaacatccagcaaatcatcctgtaactggaatgcaacccctatctgcataccaaaattataaagattctccgcatcagcggcagacgctcctgccagaatcgcaccgatcttcagacttgcggcaagcaatacagccgttttcagacgaatcatttcaatatattcgtcttccgccacatcgttgcgcgactcaaattccatatccaactgctgcccttcacaaatttccaacgcagtcagactaaacaaatcaatgacttctttcaaatgctcgggcgcacaaccggctacataccggaaagccagtatcagcatggtatcacccgacaaaatagctgtgttatcgttccagaccttatgcacagtcggttttcctctgcgcatatccgaacgatccatcagatcatcatgcaacaaagtgtgattatgataaacttcgataccggtagcaggatcgtaaattgatgaaacatcttccttatacaagttatatgccatcagcatcaatacaggacgaatccgctttcctcccagagaaaggatgtattcgattggttcgtagagtccttccggagtccgggttatctgaatttcagataggtggttgtttattttatcaagtaattgagaagctgtaaacatgatgaaaacaaagattaatgaataaaaagaggctgcattcgcagcctcttaaatgtatgagtgttacaaattactgcaatctgaacattacaggaactgtaaatttaacgcgaaccggtttaccacgctgcatacctggtttccatttcggcatcgtgttgatcacacggagagcttctttatccagatacgggtctacactgcgtacaacttttgcatctacgatactaccgtctttgttaacaacgaactgtacgataacacgaccttgagtaccattttcctgtgcgatagtcggatatttgatatttttagccagatactgcatcaatgctgcctgtccacccgggaagtccggcatgttttctacaacttcgaagatagtctgttcttccggctcttcctcaactacttgtaccggtacgtattttacttccactttcggtgtgttatcctcattaaggatggtagttgattcttcaatatctgcctggtcatcgacaatttccagcaattcggccaccttcggtgcctcgggtggtggtggggtcgcttgttcaggggtttcggtaataggaatgatttcctcttcaaaaacaacatcagctacagcctggcttgtatcgattttcacgtcacgctgggtccattcgaacgccacgaacataaaagccaataccaccacgtaaccgatcagcagccatgtggatttctttccttccaggtctgccttgggtgattttttaacttccataattttgttaatataatgattaataaaaaaaagtgtcttcctatgtgtctctgggcaaatatactacattttcagataaccgtccgtttctttgtatctttttatccggctttttaacttttttaattctttcatactcattcagttgcttttacagtcaaatctatggctgattttcaaaataagcgtatctttggcggacaaatataagaagcagataatatgaaaaagataacaatcgcaatcgacggcttttcctcctgcggaaaaagtacaatggccaaagatctcgcccgcgaagtaggatacatttatatagatagtggggcaatgtatcgcgcagtcaccttatatagtattgaaaacgggatatttaacggagacgttatcgatacggagaagctgaaagaagcaatccgggatatccggattactttccgccccaatccggagacgggacgtccggacacctacctcaacggggtgaacgtagagaataaaatccgtacaatgggggtttcgtccaaagtcagccctatcagcgcactcgattttgtacgcgaagcgatggtagcacagcaacaggccatgggtaaagaaaaagggattgtgatggacggacgggacatcggaaccacggttttcccggatgcggaactgaaaatatttgttacggccacaccggagattcgtgcccaacgccgttttgacgaactgaaagcaaaaggccaggaaggcagtttcgaggaaattcttgagaacgtaaagcaacgggattacatcgatcagcatcgtgaagtgagcccattgcgcaaagcggacgacgctctgctgctcgacaattccaatctgagcatcgaacagcagaaggaatggctgtcggaacaattcgggaaagtagtaaaggaatagaggatagaaatcgagtgtatgattaaagtagagatagacgaaggttccggcttctgcttcggcgtggtcacagccatccacaaggcggaagaagaactggcaaaaggagaaacgctctattgcctgggagatattgtacacaacagccgggaggtagaaaggctgaaggcaatgggactgattacgatcaaccgtgatgaattcagacaattgcgcaatgccaaagtattgcttcgcgcacacggagagccaccggagacttaccagatcgcccacaagaataatatcgaaatcatcgatgcaacctgtccggtcgtactgcggcttcaaaagcgcatcaaacaagagttccggaaggaagattttgaagaaaagcaaattgtgatctacggcaagaacggtcatgcagaagtgctgggactggtagggcagaccggcggtcaagccattgtcatcgaaagtgcggaagaagccaaaaagctggatttcactaaaagcatccgccttttctcacagaccacaaagtctctggacgagtttcaggagattgtagaatacatcaaactccacatttcaccggatgccactttcgaatattacgatacaatctgccggcaggtagctaaccgtatgcccaatctcagggaatttgcggcaacgcacgatctgattttcttcgtcagcgggaaaaagagttcgaacggaaagatgctttttgaagaatgcctgaaagtaaacgccaactcacatctgattgataatgagaaagaaatcgatcccactttactccggaatgtgaaatccatcggcgtatgcggagcgacttccactcccaaatggctgatggaaaaaatacatgaccatatccagctattgataaaagattaaaaagaaagatagaagagacaatttgaatatttttaatggtttcgacacacgaaaaaaaacttatgaaacactgctttcaactttttgttgtacatttgccacgtcaaactaattaatgaaagattgttatgggaacagttaaatgtatcggtattttgacttcgggaggtgatgctccgggaatgaatgcggccatccgcgcagtaacacgtgcagctatctacaacggactacaagtaaaaggtatatatagaggatacaaaggtctggtgacaggcgaaatcaaagagttcaagagccagaacgtaagtaatatcatccaactgggtggaaccatcctgaaaacagcccgctgtaaggagttcaccacaccggaaggccgccagctggcttatgataatatgaaaagagaaggcatcgatgctttggtgatcatcggtggtgacggttcgctgacaggcgcccgaatcttcgcacaggaattcgatgttccatgtatcggacttccgggaacgattgacaacgacctttacggcacggataccactatcggatatgataccgcattgaacaccattctggatgcagtagataaaatccgtgacaccgccacttcacacgaacgtctgttctttgtagaggtgatgggacgtgacgccggattcctcgctctgaacggcgccattgcttcgggagccgaagcagccattattccggagttcagtacggaagtcgaccaactggaagaatttatcaagaacggattccgcaaatccaagaatagcagtatcgtactggtagcggaaagcgaactgacaggcggtgccatgcactatgcggaacgtgtgaaaaacgaatacccgcaatacgatgtgcgtgtgacgatcttaggacacttgcagcgcggtggaagccctacagctcacgaccgcatcctggcaagccgtttgggtgccgctgccatcgacgctatcatggaagaccagcgcaacgtgatgataggtatcgagcacgatgaaatcgtctacgtaccattcagcaaagctatcaagaatgataagccggtcaagagagatctggtcaatgtattgaaagaactttctatataataaaggtaatacattcatataaggtaatataaagaacggtggacgcaatgagagattcaatggtccaccgttcttgtttcaataaagctatcactatttccaggagtccgaaccgatataccggcattctttcaagcaatatctcttttccccgcggcagataaagcgatcgtcttttcacgctttctcttatttatcattttcttaatccacaaataataaccggtcaacggcaaggaagcgcccactaatgcagccaaaaaagtaagtatacgtgtcgtcatacctccccagttgcctacatgaacagagtaaatccaaccgcgtatttttcctgccttatcctgatgctgataaagactcgtctctgtaaattcaccattttccgtattaaatgaataacggtcagcagcacgttgattccccaaacggtcgaaagcaacgctagccgtaccggaggaaacactgatctgtttgtatgccggattctgaagactcagcttgtcatatatttcctgccaataagcaaaggcagaaacaacaggctttggctgttcagtttgctggtgtttccaatgtctgccgccctcatgcaggttgccttcctgccgttcactttgtgaataatctgcggataagccttcctgtttttctcgatgcggcctgtccggacgacctcttctgccacttccacgttcttcggcattctcccgtccttcagtttcagccttcggctttccatcctgcaaagccagtcgggcatctcctttggaagtgctttctttctgcccgtgcccatgcccgccctgctgctgcacttccacgccaaaaactttataaaaggctgtccgataccaagtgaaagaccacgtcagtccggtcagcgacatagccagcagaagaaccagcgcatacattcctcccgccacatgcaagtcataccaaaaccgcttccagcctttcgtgcccgatatcttcagactatttttcaatgccttacgtgtacgcggccaccagacaatgattccggaaatcaagactacgacaaacatcaaagtgctgacgcctacaatcatctttccccagaaaatcccctcacctcccggattcatactatccagcaaccagcggtgcatccgaaacataaacgcaaaaaaaccgctgcgctgattctttccggtaatctcgcccgtatactgatcgacatacaccgaagaacggcggggtttggaaagactcacctgataagtgcgttccggatcagaggaaatgctgacacctgacacagaaacatcgtcgggcaacgtggcagccaccttttccaacaactgatcaaccggtaacggagctgcctcaacctgtttcacaaagtaaagttccggccacatcagttcatttacctcattctcgaacaccagcatggcgccggagaaacagataagcgtgattattattccgaaggggactgagagccacaaatgaatttttcgaaaaaactttctcattgtatttgtatgggttacttttggcacaaccttgctgatttcatgattggcaaagaatattcaacatttagtctgtgaaagtagcgtcaacagctgatgaagagatgatattttctccaaaaataccgtaagtggtaaagcgggtaatcgtatattcgttcgaacgtttcgcaataccgccgtttgtattcagttcataagctgtggttacaccttcatttccctgattgtattggaggcgatacagatattggtctttgtagaaaatccaggcagtaccggtagcagtttcaaatccgttattgttgccgggagttacactgccactttcgagagtcgaggtagccagtaagtagttggctgtactgttggccgatgttacggtagccgatacgacgtaagttgagtgcgaatccttggcaagtctacctatcgcagtgattccggtagcgttgacagtcagcccttttgttgccgtatgagtaaccggatcaattttataaatagccggatgattggtttctccgtctgcagtaatgggaatgacgccgacataagccacgccgttctcacaaaacggggtaccggagaaagaagagatacgatccggttcaggcagtccgtctacatagtacagttctcccttatccccatttcctgtcgccttgaagacagccattcgcgtagctcccgtgccacgtgagttaatttcgcctgtgtacatctgcaacaagaaatagtctccggtgatgtgccagcagcgcaggaatgacttgccgcccgagagttcttccagattacagtaatagctgtcaaagtcagtcgcgccagctttgatgcggaccactcctgccggtaagttggttttctgtacgtcggcatccatgatcttggcataactcggggaaaacacatatacgtctccattgtcggcagcccaaatcgtctgataatactgtgaacgcatacgtccgcaagcataactgattttgtccgtcctgatcagcgtcgggttgttgaagttttcatcgttgtagatagccacccatgcttcgttggggtactgagtccactgcagttcccctttctcatagctggagctgttgctgcctccgtcttcggttttcaccagttccggatatttcacccacttgccatcttcaaaagccgacccgtatacacttagtcccataggaataggagcggtataaattttattgttggcttcaagaatacctgcgaaagtaacgtactcgccatttcccaaaaagttttcgccacggatgacatctctgtttttcatgatctggtcagtcacatgcagataggtaatagctattcccttctgtacggattgcgtttcttccggagcaacggctccctcagtttcatcacaagaggtacaaagcgtacctgtcaacagagccattgcaaagctccacatcaaaaaattcttcttcatctttttttgagtatttgtagttaatcaaattgtttttatttctctcaggtttaaaattctttctgtttcaatttccgccgaagtacactctcactttcccatagaaggcacgaccggctttctggagactgaagttatcatagagtttttcgtcagtgaagtttttacattcgaacgatacgttatatcgtccattcttcagactgtaggtgatgcccagattatgtgaaaactgtgtaggcactatgtctttggtttccaccgctcccaatgcttcggagtaaagcggaaaaccatgtacatacatattgtcataggtaacggtcagcgtatttcctttcttccagaggttccgccagaagaaagagatgtccgaattggcaaaacggtaaggcaagttcggcatacgtgcgccataagtcagactttcctgcccggtctgcgttttctccacattgtcacgcacgtccatttgtgtaaagtttccgccgatactgacccagcaggagtaattataacgcgcggaaatatgatagccttttgtttcaacacttccatagttgctgtaagagccgtatgaacggttgctcgttgtttcgatactgcgatagatataatcggaagtattccggtaaatcagtccggtttccacatacagaccgtgtttacccaattggcgattatagctcaaattgaaattgaggttatcacttttttccggattcagtcctatttttcccagttcaaggtcttcgtcaccaaaaagttcttcgttcgtaggcagccggtaagccttctcataagaaagttttgcctgcaatcccgaaaggatgaaataagtaccggccgcgccatatcccacagagcttacattattggtgagacggacgtagttactcgttccactggtcgatgcggacacgggccccgcattatattggttgtaatatttcccgaatacggataaattccagtgctccgaaggcatcagcctgtatgaaaatccggttatatttttgcgggtcactttggcgatagcgttcgattcatcgacagaaacggagttgtgattttcacgatgaaaggtgttcaagacgtggttcagcacaaatgtatgcgcagtgccgatgtggtagttggcggtaaaagtagcgttccagttgtcgttgtcggacttcatatcctgatatgactgttctccttttctccctttcagagaggttttctcaccaagccagttgaaacggtacgttgccgtatcgacattgttcgtaaagttccggttgtaattggctgtgaatgctacgtccagattcctgacgaataaattacgtttacgatattccagagaaggcatcagagagtttcccttacgatatttttcaccaaatacgaccttttgtaccactcctgtctggatttctttgtacatacgcgagtacgtcagtccgatcatcagacgatccgcccatttcttgtcaaccagccctactttgccgacaacagcctcgttgtgatagttgtcatgaaagcgtttcacatgttctaccttgtccgtattgatagccgagccgccgccttcataaaactcttcgacaggggtatccacatagtaactgttgtcagaatagttttggaaagcgttgatttcgtaagtcagtccattcttgaaggtctgtccgaagttgacgtacgatttatgtgtattgaacgagccgtaagagtaggatgcgtccagaaaccagtttttccggtttttattggttacgatattgataactccgcccaaggcatccgtcccgaacccgacaggcactacaccacggtacacttcgatgcggtcagcaaagttaatgggaatgttgttcagtccgaaagaacttcctacgccctcctgcggcactccgtcaataaacagcttgacgtgcttgccggaaaatccgtccagcgaaagaatcatatccgaccccactcctccggcttcccgaagtttgagtcccggaacttttgccaaggcatcagaaaggttttgtgtactgttatgcagacctttcgcatcaattgccaccgcattaaaggcagatttatttacccggctcactgcagaagtggacactaccacttcattcagttccgtcacctgcggagcaatcgttacattgacccttattctttcaccggctttcagtgtcactttcttttctactgtcgtatacccaatggccgatacaaccagagtgtagtcgcctgctgccgctttcaagtgatacaatcccttttcatctgtagtcgctcctctgttcgtccctttcagatatacagtcgcaaagtccaccacttctttttctacagtagaaatcactcttccggaaatcatccctccggatcgcccatgttgagaaaatgctgacactgaaaataagaacgcaagaaaaaccagaaaacttttattgatcatctctttttactctatttacttaatacctactatatagttccgataacgaattctaaaacgatacaaaggtagtgacaaatagagatgcgggacaatccccatctattggtaaaaatagatcaacaaaaagaagatatccggagatatacaatacctaaaaataagtaatcacagcataaattaaataaaaacagtattatttcaaccagcgttccaaagcctgttccgtttcctgccacagttgtttttgctgcacatggcagaggtatttttcggacagctgcttcctgtggctgctcgcataaagctgtccgctgactccggccactgcctcatccagcaagaggccgacggcagtggaagcccctttcttcggcgtgcggataaaggggcggaaaaagatatccgtcagagggtcaaaccactggtgcatagtgatgatgtcggtagaaacaatgccgggatcggcggcattgacagtgattcctttttcacggaggcgttccgaaagttcgatcgtaaacagcatcaaagccagtttggtattgctgtaaacagggattcgccaaaaacttccctttcttccctgccggaagaaatcgggaaaatcgaggtgtccgatcgcatacgtgcaagaaaccatgtttacaatacgggctccgcatgtcaatgccggaaggagtttccgggtaagcaggtacggccccagatagttcacactgaccgttcgttcaaagccgtcgtcggtgatgtgaagtccggtttccattgttccggcgttattcatcagcagggaaacggggagatgacgctccacaatccgatcggcaaaagaagctgtcgatgccatagaagacagatcgactgccatgacttccatgtttgcgtttcctgtctcgttcactagacgctgccgtatcggttccgctttggacggacgatagcaagccataataatatggtaaccggcttcggctacggcacgggttatttccgttcccatgccgccgtcggcaccggtgatgattgcccatttctcttcactcattgcttttccagtttttcaatctcccgttgcaggcagggaggcagtttttctttcagatgttggtggcaggccatttcgattgtgtacatccgcccgatgcagtagttgctgtgtccgcagttacagcgcgcctgctcttcccgcctcatccggttgacaaactccggttcgttgagcaacgcacgtgccatctggacggcatcgaagccggcatccaatacttcatctatcttttcgcgggacaccagtccgcccacataaatcaacggggcttccggaagtgccgcccgaaatttcagtgcatcctccaggaaataggcttcccggaaaggaacggtcggaatcatccactttccaaacatccggactccgtatttcagccaccagcagtccatgtagtaagccatcgaacgaatcggcatcgctccccgcatgacgtacatcggggccttgctgacgaatcctccgctcagtaccaatgcgtgcgcgcccaatgccagcaggcgtttggccacttgcagagattcatcggtttccatgccgcctttgaagccatcgcgcatattcatttttacaatgactgccatgtcgcttcccgccgctgtcatcacctcgttcatcaccatttccataaagcgcatccggttttggagcaagccgccgtagtcgtctttccggtgattggtgtagggagacaggaactggctgatcagatatccgtgtccggcgtgtacctcgacggcgtcgaagccggcttcccgtgccaagtggacagcccgtccgtaggctctggccatctccggcaactcttctctcttcatgccacgcacgaatgtaggagaatagagattgaaaccggtagaagctgaaatgggagtggttccgcaaatctttttatgggacatatttccgcagtgccctatctggatgcctgctgccgcaccttccgtgtgtatagctccggtcacttcacgcaaaccggaaatgatttccggacgcagccacaactgacggtcgaaggaaagtccgctttgtgtcacggctgcataggctacagtcgtcatcccgactccgcccgcagccaccgagcggtggtaatcgagcagcatttgtgaaggggcgttaccgggacacatgctttcaaaagcggcagagcggatcgtacgattccgcagcgtcaatggaccgaaagtaacaggggtgaaaagtttagattccatagtacgctattttatgtcaatagataatttatttcaaatcaatagataaaaggaaatacacgtttgcgttcgcctacttccgagccaaattcttcacggtagcgatgccagattgcattggcacgggggacgagattggccactgtccaccagaagaatacaagtccggatagtgaacaagtcagtattgcccagcctgcccattcaatgatttcgcccagataattggcggaagtgacatagcggtacatccctttttgtggcagataatgacgggtatcccccggtttgcgcaaatggcggatgatatagtccgaatgccagttcatcaacatgcccgcaaagaaaagcagactgcccgcaataaaccatgcggaagtgaaccagccggaatgatacattccctcgggtgagagataaaatatccattcaccctgcatatagccgttcaatagattgaacaggattcccatcgacatgattgccagcggcattttactctttccggtcagtagcaggggaaagacgaaggcgcgctgaaaataatgaatctgaaagaagacaaagaatgtcagtatgaccggatcaaaacgacgttccgagtgtatccacatccagcacatgaccagaaatacgggggcttccatcagtatccacgccagcttgttggaaatggcaactccccaggaggcggtgcgaaatatcccgtaaccggctttcacaaagtagagggcgatgaaaacaatcagagcggtcagactcatgacgcccaaaaatagattaaaggcagctatactcatcttgattttcttttgagattcacaaaaataacaaaaaaagaaaagaatggtcacaaaaataactcaaataaaaaacagatcaaacgacaacagacttccggcattctttgtttattcattaaaaatcagctatctttgcagttggttatgaactaaataatagaaaaagcaatggcaatggaaattaaagccataccgaccttaaaaggaaaagaagcggaacacttcgttaaggcagcggacaaggcttataaaaatcaaaacaaacaagacttcagcaaacatgtgctggaagcccgtgctgtgctcaaaaaggctaaaatgttataaaacatgggatttctttttgagaaatgtacttttgccgtacttgatgaagatacgattaaagaatgtgaccctttctcatgtgggcaccaagacttagacgacttctttcataacgatgctcctctctataatgcacagctattaggaaaaagttactgttttcgttcagataaaaagccttcggacatagtatgtgccttcactgtttctaacgatagtatcagagtaaatatcctccccaacagcagggaaaagaaagttcagaaagacattccccgagccaaacaaatgcaccgctatccgggtgtattaatcggcagacttggaatcaataaagaatacaagcatcagggcataggcagtgatctgatgactttcataaaatcatggttcattgatgcgggaaacaaaacagggtgtcgctttttaattgttgacgcttacaatgaaaatattcctctgaactattatctgaaaaacggtttcaaataccttttctctacggaagcgcaagaagtggaatatacaggctttgaaaccggaacgcatctaaaaacacgcttaatgtattttgatttaatagacattataccttatcccaataatagcagcaaagacgcaatcgacggtaattattaaaataacaagtttgttctcaacaggtcacctgtccataatctctcctccagcaaagggaaagatcatagttcactgatatccaaagaaatagaatgtataattcatcggttgtagaaacgcccttttaacgtagcgttaaaagggcgtttctacctgccaggctgtgccctttctaccaacgataaatgccttagcctccatcggatgaaaaatacagcaaccgcaaagtgttaaatgttaaatgaacatcggatgttcttcctgaaacaagtcaccccagacgtacaaccgggtactaccaagatgtacaactggggattaccgagacgtacatgcagggattaccgagatgtacgtctgaggttagttattattgcataaaaggatttgttcttatcagcgtttcttgatggggatataagccagatcatcaagaacatttttataagccggacggataatgcgtttgccttcgaagttcagttcctcattgcggtgcgcacaccagccgacaatacgagccatggcaaacagcggagtgaaaatctcctgcggcaaaccaatcatctcatatacgaagcccgaatagaagtcgatattgctggaaaccgtctttccgttgttcttcacacgtccgaaagtagcgatggcacgctcttcaagcagttcgaggaaagcgaactcctcttcttttcctttctcacgggcaaggtcgcgagccagttctttcagcaacagcgcacgaggatcggaaatcgtgtaaacagcatgaccgataccgtaaatcaatccggtcttattatacacttccttattcagcattcgtgtgaaataggtatctatctcgtccacgctcttccagtccttgatattctcctgcaagtgatggaacatatcggccacctggatattcgcgcctccgtgaagcgggcctttcaacgaaccgatacctgcggcgatggccgaatatgtatctgttccggtggaagaagtcacacgaaccgtgaaagtcgagttgttaccaccgccgtgttctgcctgcaaaatcaatagcaagtcgagcgtacgggcatccagttccgtataatcttttttgagcatatagaggaaattctcggcaatagagagtttctcctgcggatgacggatgtgcagggaacgaccgaatgtagcatggcggagcatattataagcatacgcaatgatggtcgggaacttggagataagatcgatactctggcgcatcagattatcgcgggaagtatcgtcggcatcgggatcgaaacgatacatttcgagtacgctgcgcgaaagaatattcatgatattatttccctccagctcgataatattcattttcgtcttctgttcgagcgccatattgtcattgatcagttcgcggaaagaagccagttcttccttgtccggcaggcgaccggaaagcagcagataagccacttcttcgaagccgaaacgtttttccttgatgatggcgtgggaaatgtcttccacatcgtagccccgatagaacaattttcccggaattggcttcagaccgccgccggggatacgttcgtaacctaccacattaccaatctttgtcagacctaccaatacaccggtgccgtcttcattacgcagtccacgcttcacgtcaaacttggggaacaattcattgtcaatccgggttgcctctttcatctcctcggagagcttgtaaatcaaatactctttcttcataatacttcgtttttaatcgttacatttacttttcgattctttccacaatttcgcgtgtgaaagcggtggtagacagggatgtacctcccggcataaagcgagccagatcgtgcgtggcacgggcatcgaggaaactctgttccaacgccttttcgataagcgcggccgcttctttccatcccagatattcaagcatcatcaccgccgaaagaatgatagaacaaggattcacgacatcctttccggcaatgttgggggcggttccatgagtcgcttcaaaaatggcgtgccccgtcttgtagttaatatttgctcccggagcaatgccgatgccgcctaccattgccgccaactggtcggaaacgtagtctccgttcaggttcagcgtggcaatcacggaatattcttcgggaatcagtaatgtattttgcaggaaagcatcggcgatgcagtcctttatcaccaaccggccgtctgccaaggcgtcgccgaactcacgttgcgccagctcatagccccatttcttgaagcctccttcggtgaacttcataatgtttcctttgtgcaccagtgtcacggaaggcagatgatggtcgagcgcatactggcaggcagcccgcacaagacgttccgtgccctcacgggaaacaggtttcactccaaaagaagaggtctcggggaagcggactttcgtcactcccatctcgtttttcaggaattgatagaacttttcggcttcgggagtacctgcctcccactcgattcctgcatatatatcctccgtattttcacggaacacgcacatgttcactttttccggtgctttcaccggagaatgaacgccttgataccaacggaccggacgcagacaaacatacaaatccagagtttggcgcaaagccacgttcaaagaacggattccaccgccgacaggggtcgtcagcggccccttgatgccgatcagatattcttggaaagccttcatcgtttcatccggcaaccacgaacctgtctcgttgaaagcgcgttcgcccgccagcacttctttccattcaatccgacgtttgccgccgtatgctttctgaacagccgcgttcacaacggactgcatcgacggagtcacttccgctcctactccgtctccggtaatataaggtacgacaggcacatcgggcaccgatagcgtaccatctttttgcatggttattttgttcatttctatcattttaattatctggcattcaaggcagagccggcacggaaccaggcaatctgctgttcgttgtatgtatgttgcacttcaaaactctctttcgttccgtcttcgtgatggagaacgacggtcagattccgtcccggagcaaagtccggcaagccgatgactgaaaggaggtcgtgctcctgtatcttgtcataatccgctttgtctgcaaaggtaagggcaagcatgccctgctttttcagattcgtttcgtggatacgggcgaagctcttggcgagaatcacacgcacattcaggaaacggggttccattgccgcgtgctcgcgactggagccttctccatagttttcttcggccacgacaatagaggggattccttcggatttatacattttggctgtgcccgaaacggttccgtaggtgtttgtcgaacggttccacacgttgttcgtttcgccattgaacgcattcacggctcccattagcatattatccgaaatattctccaaatgtccgcggaaacgcagccacggtcccgccatcgaaatatggtcggtagtacatttgccctgcgccttaatcagcaggggcatattgagtatatcttgtccgtcccaagcggggaaaggagtcagcagttgcaggcgttgagaagccgggttgacgttgatcgctgttttcgtcccgccgggggtgatatagccttcattgccggaggtgaaacctctcaaggggagttcatctcctacgggttcggccagtttcactttctcgccgtcatggttcatcagtctgtctttcagcggattgaagcaaagatcaccggcaatggtcagtgccatcgtcagttcgggagaagcaacaaaggcgtatgtgttcggattgccgtccgcacgtttggcaaagttacggttgaaggatgtgacgatcgagttcttccgtgtcgggtcgtccgtatgacgtttccactgaccgatgcaaggaccgcaggcatttgccatgatcacggcgccgatctgcatgaagtcatccatcattccgtctctttcggcagtagcgcggatttgctcggaacccggattgataatcagcggggaagccacactcagattcttttccttcacctgccttgcaagggatgcggcacggctgagatcttggtaagaagagttggtacacgaaccgatcagtccgacttccatcttacgcggatagccgttcagtaatactttttctgcaaattcagagataggggtagcggcatccggtgtgaaagggccgttgatataaggttcgagcgtggacaagtcaatgtcgatgacacggtcgtagtacttttccggttcgtccgtcacctgttggtccgcacggagctcacagtccacggcttccgccagttccacgatgcgatccctgccggtggctctcagataagtagccatgcgcccgtcgaacgggaaaagcgaagtggtagctcctacttccgcacccatattgcaaatggtcgctttgccggtagccgacagggaagctgttcccggtccgaaatattcgatgatggagttcgttcctccttttacggtcagaatcccagcaagtttcaggatcacatctttcggggaagtccagccgctcagttttccggtcaggcggacaccgataatccttggcattttcagttcccattccatacccgtcatcacgtctacggcatccgcaccgccgacgccgatggccaccatgcccagtcctccggcattcggagtgtgagagtcggttcctaccatcatcccgccggggaaagcgtaattttcgagcactacctggtgaatgattccggcgcccggcttccagaagccgatgccgtaacgagaggatacatcgcgcaaaaagtcgtaaacttcttcgtttgttttggttgccgtagcaatgtcctcctttgctcctttgtacgcttgtatcaagtggtcacagtgcacggtggagggaacagccactttttcttttcctgcattcatgaattgaagcaatgccatctgggcagtcgcgtcctgcatagcgacgcggtcgggacggaaatttacgtagtcttcaccccgcttgtagtttttcagatcgccctcattgaacagatgggcatacagaatcttctcggctaacgtcaatgggcgtttcaaaacagcccgcacgtgttccacttttcctttataagcagaataaaaagcctctaacatagtcaaatcatacaccatattgcttttattttttttagtctatctataaaaataacgaacggcgttcgaggaatgtttaacaaaatgaaatatattttcgtctcaggaagaagatttattacctttgcgtctattatgaataatcatccgaaaagtccaatcatcgaccttcagcaacagcaactcctgctacgcatggagtatgaacacgaaaaggaggaattcaagcggcagactgaaacaatgggtgtcgcccgcaaagtgaaacgtggtctgtgctggtatcccgcctctcccggtcgaagttactataattctctaaatcaacttgtaatagatattacacgcaccgaaaataaagaaatcgagcattccttcgaattcggtcgtcccgtctgctttttccggcagtcatttgacggaaaagtgaattacatgaatttcattgcaacggtgagttatgcggacgacgaacggatggtggtcgtgcttcccagtgcgggcgccttgctggaactgcaaacggaagaggtgctgggtgtacaactttatttcgatgaaacgtcctatcgtgccatgttcgaagcgctggaagacacaatccgcgctaagggcaaccgccttgccgaactccgggacaccttgctgggaacacaaaagccgggattccgcgaattatatcccgtccgtttcccgtggctgaacagcacgcaggaaacagccgtaaacaaagtgttatgcacacgcgatgtcgccatcgttcacggccctccgggaaccggaaagactaccacgctcgtggaagccatttacgaaacgcttcaccgcgaaccgcaggtgctggtctgcgcccaaagtaatacggctgtggactggatttgcgagaaactggtagaccggggtgtgcctgtcctccgcattggtaaccctacacgtgttaatgacaaaatgctttctttcacttacgaacgccgctttgagaatcatcctgcctaccccgaactttggggaatccgaaaatcgatccgtgaaatgggcagccggatgcgtcggggaagttactccgaaagggaaggaatgcgcagccggatgagccgcctccgcgaccgtgccaccgaactggaaatcctgatcaacgccgatcttttcgacagtgcccgtgtgattgcttccacgctggtcagcagcaatcaccgtttgctcaacggaaggcgtttccccaccttatttatcgatgaagccgcccaggcactcgaagccgcttgttggatcgccatccgaaaggccgaccgtgtgattcttgccggcgaccattgccagctccctcctacaatcaaatgtatcgaagccgcccgtggcggactggaccacactttaatggaaaaggtcgtgcagcaaaaaccttctgccgtctcgctgctcaaaatgcaataccggatgcacgaagcaatcatgcgctttccctccgaatggttctacaacggtgaactggaagccgcaccggaagtgcgcaaccggggtatccttgacttcgacactcccatgaactgggtagatacctcggaaatggacttccacgaagagtttgtaggcgagagcttcggacgcatcaacaagcaggaagccaacctgttactacaagaactggaagcctatatcaaccggatcggcaaagcacgcatcctgaacgagagcatcgacttcggtctgatttcgccctacaaggcgcaagtgcaatatctgagaagtaaaatcaggggaagcagttttctacgccctttccgcagcctcatcacggtcaacacggtagacggctttcagggacaggaacgggatgtcgtatttatcagccttgtccgggcgaatgaggacggacagatcggttttctgaatgatttaagacgaatgaacgtagccattacccgcgcccggatgaaactcgtgattttaggggatgcaacgacgcttgccaagcatgcgttctaccggaaactgatacagtatatccggcaggaagcggtatcttcctgaatcatagggataaaatacaaggaagccccctttctcacgaaagaggactcccacttacaaacaaaacaaacaatgttattttcccactaaattctgttccaaaagctctgtcttaaatacaatttaacgcatactcattcctgctacagaatgaaattctgcatcatacccatgaattactaatagaacacgaaatattaaaaggacttgaaatggcattactcctaccattcggtagagaataacttaaatatcttttgatgtaacgttctgatatactatttattaaagaagaaatcatctgcacacgtaccgatcttctgaaagtaaaaagtgtcttcattgctcattctgttttatttgttgacgcaaaggtaacaataaatgctttttttcatccatactacccatgtcttttaatcttttttgctactttcatccttattctgtcgttcaaaagagtggtatacacatagaagaggcgggaaaagatgattttcccgcctcttgaaaaacttatatagtataagtctgattagttattttccggacgaagtttacgaactgttacggcagtctgccacatttcgctttcgcgcaatgctttcagttcttcttccagtttctcacgataatccggtttggagttagagtcgattgaaatctgtgcttcgttaccagtcttcacactgtgatacaacttttcaactaccggtttgatagcatcgtggaaggggcccatccagtcgagagcaccacgttgagctgtagtagagcagttagcatacatccagtccataccgttctttgcaaacaacggcatcaatgactgagtcagctcttctacagtttcgttgaatgcttcggaaggagtgtgaccgttttcacgtaacacttcgtattgtgccagcaacagaccctggatagctcccatcagtgaaccacgttcgcctgtcaggtcggaagtagcttcacggatgaaagttgtttcgaacaaataacctgaaccgataccgatacccagtgcgattgttctgtccatagcgttgcctgttgcatcctgatagatagcgtaagaagagttcaagccgcgaccttcaaggaacatagtacgcaaggatgtacccgaacctttaggagcaaccatgattacgtcgatatctgcaggaggaactacacctgtgcggtcactccatgtaatagcaaaaccatgagagaaataaagagcttttcctgcagtcaggtaaggcttgatagtaggccatacagacattactgctgcatcagacaacaggcacataatgatcgtacctttttcgcaagcttcttcaatactgaacaaagtttcacccggaacccatccgtcagcaaccgctttgtcatatgtctttccctggcgttgaccaacgattacattgaaaccgttatcacgaaggttcagagcctgtccgggaccttgtacgccataaccgattacagcgattgtttcatttttcaatacttcacgagctttttccaatggaaattcatcacggataactacattttctacagttccgccaaaattcaactgtgccattttttttgtttttttgttttgatgacttgcgccatctgttattaattgattttatactctatattattcaaatatcactttggaacggcatactacctcgctgccgtttttcttcacctctacatgaaactcgttttcattcgcttcatcacagaagaaagagagttcatctccgaaataactttcagccacatacgccatttcaaaccggcggatacgtttcgtctgatacagttctatcggaaacaagtcaagtatgtgctcgatataacgaatactgtttacgtgtccgttaatatcgatatcactgtattttgccgtcagcgtcgcaacaggctgattgcttgtcaccttgatacgcgaaggcttttctatcgggcagggttcatcgcatatataatcgacgatgcctcctccatgcaatgccaacagatcggcaggcttacgggtattcagattgatcatcgcccatacggaacgggcatagccgatcttctttccatccttgtcaatgacagcaaagttacggtcggtaaagagacgatagacattctccacccatgtctgaaccgagaacttctcgtattggtaaggcatctcgtccagctcgatcgccagacgggaaagcacccatgtgtaattgtcctcgttcagcgtagcaataccaaatccacggtcgctggcatgaaaacctgcgcaattcagcagatgatttcccagcacgcccattgtcaggcggccgttaaaatctacgtggaacggctctgccacaaactgataagtccctattttattttcttcactcattactcctgttcctttttactttgcttatacttcgcttcctgtccgtccaggaactcattcacacgttcgaaacagctggtagtaatagccacacgacccgaacggacaaattgcagaacgcatttcaaagcccgaagttcttcgtaaagggaagtaatctcttcactcatgccgttcttctcaacgatagagaataccggattcacctctacaatgcgggcattatatctgcggatcactttagatgcttccggagtctcctgaaaagcaggagtagataccttatataaggctatctcatggaaataaatctcgtcttccgtaaaatagtgcgcctgaatcacatcaatcttcttttcgatctgcttcaccaccttttcgatagtgtccttatcagtccacgctgtgatcgtatatttatgtactcctttaatggaagaagcagaaacgttcaaactctcgatgtttatttgccgacgggtaaatacagcggtcacctgattcagcaatccggctatattttcagaatgaactataatcgtatataatgtcttatcactcataactttctaaattaaggattaacattccagcaacatctgattgactgaaccgcccggaggggtcatcgggaggacattgccttcttctaccacacaggcttcgagcaggaacggcccgtctgtcgagagcatttcgtcgatggccgctttcaattcctcccgtgaaaagacacgtttggaaggaatatcgtaggcggaagcgattttcatgtaatccggattcagcatcggagtaaatgaataacggcgattaaagaacatggcctgccattggcgcacgttgccgagataattattgttcaggcagataatcttcaccggagctttctgttccataatcgtacccagctcctgaatattcatttgcagtccgccgtcacccataaatacgcataccatgcggtcgggacggccgaaagtagctccgatagctgccggaaggccaaaacccatcgtgccgagtccgcccgaagtaacgatactacgttccttggtatatttaaagtagcgggcagagatcatctgattctgacctacatctgtcaccaatatggcttcgtgacgggtcgcttcgcttaccgcacgcaccacttcgcccatactcagtgaatccgttgcaggatgaagttcgggacgaatgactttttcttcctctaccgcttcatattccttgaaactatcgacccactcagtgtgccggttctttttcagcagtccggtcacagcagccagcgtctttttgcagtcgcccaaaacggcaatgtctacctttacattcttatttacttccgccggatcaatatcaaaatggatcactttcgcttgtttggcgtaagtagccagattaccggtcacacggtcgtcgaaacgcataccgacagcaatcagtacatcacatttgttagtattgatattcggtcccagatttccgtgcatacccagcattcctttattcaacggatggtcggtaggcaatgcggaaagtccgagcaaggtacaacctgcgggcatatccgccttttcgataaaggtacgcagttcttcctgagcgcttcccagttccactccctgtcctaccaagacaagcgggcgttcggcgttattgatcagttcggcggcagcctttaccgattcttcgtctgtatcgggaaccggaacatagctgcggataaactcctgctttgtcggctcgtatttcgttttttcaacctgcgcattcttggcaaagtcgagtaccaccggaccgggacgaccactactggcaatgtagaaagcacgtgctattgcccaggctacgtcttcggcacggcgaatctgatagctccatttagcgattggctgagtgatacctacgagatcgacttcctgaaaagcgtctgttccaagaaagcctgttcccacctgtcctgcaatgacaacgataggcgtactgtctatcattgcatctgcaatacctgtgatcgtattggttgctccggggccgcttgtcaccaagcaaacaccgactttacccgatacacgggcgtagccttgtgccgcatgggcagctccctgttcatggcgaaccaagatatggttcaatgtattttgatggtcgtacagggcatcgaacgtaggcatgattgaaccgccgggataaccgaaaatggtagtcactccctgatgttccagagagcgcatcattgcctctgcgcctgttattaagtccttactcatagttctttaatggataatggatgattcataatggataatgaagtggatcagtctattaatctcactgctcccttatcggcagagcttaccatgctggcgtatgctttcaggctcttcggcacgtaacggtcacgggtgacgggagtcatcgggcgggcagccagttcttcatctgttagtcgcacgttaatcgttcgggcgggaatgtcgatttcgatgatatctccatctactatttttcctatattacctccggcagcggcttcgggagaaacgtgtccgatactcaatccggaagttccaccactgaaacgtccgtcggtaatcaaggcacattctttgccgaggtgacgggatttgatataagaagtcgggtaaagcatttcctgcataccaggaccgcccttcggaccttcgtgcgtgatgacgacaacgtcgccgctgacgactcggcctccgaggatgccttcacaggctgcttcttgtgagtcgaatactttggcaggtccggtaaacttccagatgctttcgtctacacccgccgtttttactacgcaaccgtcctgagcgatatttcctttcagtaccgccaagcctccgtccttgctataggcgtgctccagatcacggatacatccgttcgcacgatctttatctaattccttataataagctccctgagaaccaagtacgagattgaatctgtttcccgccgcacttgaatacttactcattgctttttctgttacgttcgggctggtaattgaatattgatcgatcgcttccgccagcgacatgccatccacacggagaacggaagtatcaatcagaccgccttttgccaactctgccaggatagcaatgatgccacccgcacggttaacgtcctgaatatgatatttttgagtattcggagcgactttacacaggcagggtgtcttgcgtgacagcatatcgatgtcgtccatcttgaaatcgactcctgcctcatgtgccacggccaacaggtgaagcaccgtattggtagaaccgcccatcgcaatatccagcgtcatggcattgaggaatgcctgacgggtagctatgctgcggggaagtacactttcgtcaccttcttcataatatttcattgcattttccacaatcagtttggcagcatcttcaaacagtttcgtacgattttcgtgcgtagccacgattgtgccgtttcccggaagagccaagccgatagcttcattcagacagttcatcgagtttgccgtaaacattccggaacaacatccgcaggtaggacaggcattctgttcgatattcgctacttcctgatcgcttacactgtcgtccgccgatttaatcatggcatcgatcaagtccagatgctgaccgttccactctccggcttccatcggtccgccggatacaaatacggtagggatattcaggcgcatggcagccatcagcatccctggggtaatcttatcgcagttgctgatacataccattgcatccgccttgtgcgcattgaccatatattctacgctgtccgctatgatatcacgggaaggaagcgagtaaagcattccgtcatgtcccatagcgataccgtcatcaatagcaatcgtattaaattccgcagcgaagcatcccagcttctcaatttccgccttcaccaactgcccgatttcatgcaggtgcacgtgtcccggaacaaattgtgtaaacgaattgacgatagcgataatgggttttcccatctgatttttcttcatgccgttggctgcccataatgcgcgggctcccgccatgcgacggccttgtgtactaaacgaactgcgtaattgctttttcatttcaatctatcttttaattaaagagcctccctcacatcagtgagaaaggctccaaattctatcttttatggtacgaatacatacacaaaacctttctcacgctcttgatggcaccaccacgacgcgaataatatgcagaactgctaggttaatagatgtatgtaatatattcatatcttcttttctttattttcgtgctgcaaaggtaagggcttttttattatctccaaacaaatcgaagaaaaaaatcactaaaaagcgaataatcgtaagaaaagaacggtaataaacctaaattttatcacttaaaggttgaatttgcaactatcagttagtagagaatgactgtccatttctgacaaaagcgcttaataatctgaaatttactccgtatgcacccggtagcaagcaaattattcgtatctttgtccaccctaaataagggatttattaattagaaactataaatatcagatggaaacagtagaaaacaagtacatcaccgttgcatataagctatatacagtggaagatggtgaaaaagaattgttcgaagaaacaaatgcagaacatccttttcagttcatttcaggattaggcacaacgctcgaaagcttcgagaaccagataacagctctttctaagggtgataaattcgattttaccattccggcagatgaagcttacggagcctacgatgagcaacatgtatttgatcttcctaaaaatatctttgaaatagatggcaagttcgacagcgaacgcgtaacagaaggcagcattgtacctttgatgaccggagacggtcaacgcgtaaacgccagcgtcgtagaaatcaaaccggatgtagtagtagttgaccttaaccacccattggcaggcgctgacctgatctttgaaggtgaagtaatcgaaagccgtcctgctaccaacgaagaaattcaggaactggtgaagatgatgagcggtgaaggttgcggttgcggatgcgacagctgcggcagcgactgtggcgatgactgcggttgcgaaggcggacactgccactaattttaagtaataggtaataagtattaagtattaattccatgcggatataggcggaagttaatacttaatactttttttatgccgttattccagctattacctattacttattacttgttacttattacctgttaacatcctcctttgtgcgtcatgatatcaagcaccatcttatccgtttcgttcatggcctgcgagccgattcttgtcaagttacgaatgctttgatcgacatcttcgtcaataatgccttctacagaagtcacacaacggtcctccattgccatcatagcagataatacggctgttgagactccggttgttactttgagtgcgcagctcggttttgcaccgtcgcaaatcattcccgtcaggttggcaatcatgttttgaacggcaaaggctacctgattatagtttccacccatcagccaggtgattccgcaactggaacccgtggcagctactacacagccacacaaggcagagagacgtcccaaactttgtttaatatagattacagtgagatgactcagcattaaggcgcgaatcagttcctcttcggttttaccattttcttcggcaaatacgacaacgggaagtgtggcggatatgccctgattgccactgccggagttactcatgacgggaatcattgcaccggccattctggcgtcgcaagcggcggaagtataagatagtatatgagagaatacgctgtcacccatcactttatgttcatacgttccacggagcatcttacctaaagaatgcccataattgcctttaaaggcttgctcggcggctgctttgttcagacgtgccgtatcgagaataaaacggatttcatccagaggggatgtcagggcaaaatcatagactttgcgcagattcagttccagtgaagcgtcttcttcctcttcattggcagtctgttgcttgtcaagcagtactttttcatccgtagctatatagacaaaggcagtatgtccgccggcaatcacagccgtcgctttttggctgccggctgtgcagattacttcgatgtacagtttttccgtaatatcttctttgagagaaatacagattcgcttctctgcgataaacagtttgccttgttctactgcctccggtgtgcagtctctcaacacttccagttgatattccgatcggccgatcaacgctcccaaggctacagctataggaagtccgaccatatctgtgccggggataccgactcccattgcattctttaatatattggcactcaataacacctcaatcttttccggtttcattcctaatgtttcggcagctttagctacacaaagcgctaccgcaatgggttccgtacaccctatcgccggaatcacctcttttttgatcaagtctattatctgttttctttccgattcaatcataccctataaggctttagtttccacaaaagtagaaaattcttttttatcaaacatccattagtgaacaaataaaattgcaaattgttataaaatcttccaagaaccgaactttaacagttagaatagtagaaaaatgaaagcaaaacacggtattctttatttgctgctagccattttctcttcttcttgcattcgcgaagaagctcccaatgcagaggcagacatactcagttgcagattgccgggagtagtcatgacaacgagtccgattatcactaataattccatcaatatatttgtaggaccgggaacggacatttcatcccttgcacccgaatttacattgactccgggagccactatcgatcctcccagtgggacggctagagatttccattcgcctcagcaatataccgttacggctgccgatggcttttggaagaagaagtacaccgtatccgttattgatacggaacttgctactatttacaattttgaggatacgctcggcggacagaaatactacatcttcgtagaacgggaaggagaaaaagtggtgatggaatgggccagcggaaacgcaggttatgcaatgaccggagttcccaagacagccgacgactatccgacttttcagtttgcaaacggaaaaaccggaaaatgcctgtccttagtaacccgcagtaccggattcttcggtagcattatgggaatgcctatcgcagccgggaacctgtttatcggctcttttgatgtaggaaatgcaatgagcaatccactgaaagcgaccaaattcggtctgcctttccggcatataccaacttatctggcaggctattacaagtataaagccggagatcagtttacagaaggcggcaaacccgtcagtggcaaacgggatatatgcgatatttatgccatcatgtatgagaccagtgaatctgtgccgactcttgacggaacgaatgctttcaccagtcccaacctggtttcaatagcacgcattgacgacgccaaagagacggacgagtggacatactttaaacttcccttccatatgttatccggaaaatacatagataaagagaagctaacggcaggaaagtataatgtagctatcgtattcacttccagcctggaaggagatcattttaacggagctatcggaagtacattgttgattgatgaagtcgaactaatctatcgctcggaagactgattccattcgaccaacgatctgatagcagctatggaaggcagaacagagcaactataatgaaataactaatgatttaataataatgaaaagatgaaaatccattcctatatattcagtttactcgcctgtctggtgatagccctccccggctattcacaggttgacagaaacgaaacacttattcgctccgctcttcacggactggaatatgaaatcaaagcagggttcagcatcggcggtacagccccgctcccgctgcctgtcgaaatccgttcgattgacggctacaacccaacgctggctatcagcatcggaggagaagtaaccaaatggtttgccgttcaaaataagctcggagtcattgtagggctgcggctggagaataaagccatgacaacggaagccaccgtcaaaaactataatatggaaatcctcggacagggaggagaaagaatcagcggtgtctggacaggaggagtcaaaaccaaagtctacacttccggactgacaattcctctaatggctacttacaagttgagcaaccgttggaatattaaagccggaccttatttttcgtatctgctttcaagagaattttcggggcacgtatatgaaggatacctgcgtgaaggcgaccccgtaggccccaaagtcgaatttacggatggtaaaatcgctacttatgacttctcggacgacctgagacattttcagtggggcctgcaaataggagccggatggagagcattcaaacacctcaatatatatgcagacctcacctggggattgaatgatatcttcagaaatgactttcagaccattacttttgctatgtatccgatctacttgaatatcggattcggatatgctttctagctgaccaaagacggattaatccttaccggattcctccacctgcttcacaccggagaaagcaactttcacggtctgcttcaatgcaggtacttttacctgaatattcattgtagcatttccactttgcaccgttccttctatactggtggcacaggtacccaaagcagcggcatccccctgaaaagtaaggtcttgctgtccggtgaaagtcgaagcgtccgtttcctttttcactgcacacttgtctattacgatatcgccgaactttaatatgtttccgtttataaacagttcaaattccttcagttccatctttacttccgtatcactgacctgagagaaagtaataaacttcggaagtccgtcggcaatcacaacttcctggtcagagccatcgggcagcattgaaatatcaagatttccccaatacgttcccaccacatcgggagcagtcaccacagcctcttcttccggaggagtcgtttcatcattgaccgtattatcgtcatcactgctacaagccgtcaaaagagagacagagcatatcaatgcccacaaatacaatagattctttttcataattttcgggtttagttattaaataatcgtcatttataaactaaaaagaggaaaaaaggttcaatttgcttccttttccgaagatattttgaattcacaaccttcttatcgaaaactttgttatatttgcatagagtaattttaaaaaagccacaactatgtttaattcatttggcaacatctttcggctcaccagcttcggcgagtctcatggaaaaggagttgggggagtaattgacggatttccttccggaatcacaatcgacgaagaatttgtacaacaagaactaaatcgacgccgtccgggacaatccatcctcaccacaccacgcaaggaagcggataaagtggagtttctttcaggcatcttcgaaggcaaatcaaccggatgtcctatcggatttatcgtttggaacgagaatcaacattccaatgactacaataacctgaaagaggtataccgcccttcacatgcggattacacctacaaagtgaagtacggcatccgtgatcatcgcggtggcggacgttcttctgcccgcgagactatttcacgcgtagtagccggcgcattggctaaattagcccttcgccagttaggaatcagcatcacagcttatacatcgcaagtcggtgccatcaaattggaaggcacttattccgactatgatctcgacctgatcgaaacaaacgatgtacgttgtccggaccctgaaaaggcgaaggaaatggcagaccttatatataaggtaaaaggcgaaggcgataccatcggaggtacgctgacctgtgtcatcaaaggatgtcctatcggattggggcaacccgtgttcggcaaactgcacgccgccttgggcaacgccatgctcagtatcaatgccgccaaagccttcgaatatggagaaggattcaagggactgaagatgaaaggctccgagcagaacgacgtattcttcaacaacaacggacggattgaaacgcataccaaccactccggaggtattcagggaggaatcagtaacggacaggatatttacttccgtgtagtattcaaaccgattgctaccctgctgatggagcaggaaacggtgaacatcgacggcgtagatacgacactgaaagcccgcggacgtcatgacgcctgtgtactgccacgtgccgtacctatcgtagaagcaatggctgccatgaccatccttgattattatctgttggataagacaacgcagctttaataagtatcaatatgtcaatctacccatgtgccaatacctgcactaaaaatctgtcaggctattggcacataggctaaataaccgccagtaaactattcattatgaacgaaattcaaaaatatatcgcagcgaacgaaccgaagattatggaggacctgttcagcctcatccgtattcccagtatcagcgccctgccggaacatcacgacgatatgctggcttgcgcccaacgctgggcacaactactgctcgaagccggagtggatgaagcattggtgatgccttccaagggtaacccgattgttttcgcacaaaagatcgttgacccgaatgccaaaacagtattggtctacgcccactacgacgtaatgcctgccgaaccgctggaactgtggaaaagccagcccttcgaacccgaagtacgggacggatacatctgggcacgcggagcggatgatgacaaaggacaatcctttatccaggtcaaagccttcgaatatctcgtcaagaacgaactgctgaaaaataacgtcaagtttatcttcgaaggagaagaggaaatcggctctcccagcctggaagccttctgcgaagagcataaagagctgttgaaagcagacgttatcctggtttcggataccagcatgctgggtgccgaacttccatccctcaccaccggtctgcgcggactggcttactgggaaatagaagtgaccggaccgaaccgtgacctgcattcgggacacttcggaggtgcggtagctaatccgatcaatgtgctttgcgaaataatcagcaaagtaacagataaagacggaagaatcaccatccccggattctacgatgaggtagaagaagtgccacaagcagaacgggaaatgatcgcccatattccgttcgatgagaagaaatacaaagaagccatcggagtgaaagaactcttcggagaaaagggatacagcacactggaacgcaacagttgccgcccgtctttcgatgtatgcggcatttggggaggatatacaggtgaaggctccaagacagtccttccctcgaaagcgtatgcgaaagtttcctgccgactggttgcgcatcaggatcatcacaagatttcgcagatgtttgcagattatatcttacaaatggctcccgacaccgtacaggtaaaagtaaccccaatgcacggaggacagggatatgtctgcccgatttcccttcctgcctatcaggctgcggaaaaaggttttgagatagctttcggcaaaaaaccgctggcagtacgtcgtggcggaagtattcctatcatttcgacattcgaacaggtattaggaaccaaaaccgtattgatgggcttcggacttgaatcggatgcgatccattcacccaacgaaaacttctcgctggacatattccggaaaggaatagaggcagtgattgagttccatcaggaatatgcgaaaagataaaggctgcctatagccgcacgcaggacacgaagataaaaggagaacggtagacaagcggataaatcctttgcctaccgttcctttttattcaaaaaaagacctcttaccacataactaactatcgactacatcaccggagtttcgaaaaggaaagtaaatgattgactatccttcaaatccttcacggcatctcctgcgtaaatttctcctttggtcaaggacagtttcttcaccccagccttcggactaaaatcaatcttcttcaaatccagccaaaacaggttcggagttaaagtagactcaaagtaatacactttattcttctgatcggaaacggaacgccagcgagtagaagaaatgtgaggcttctccggtgtattgataccaaacggaacggagacattgcgcatcacactcagcacactggggacagctatctttgcatcggcagtctgcggaatggcgtgaatgtagaaagaggcacgcacaaaacggtcgctcgaacggttcgttcccggcaacatctgcaatccacccacttctttccagtaatcattgacagccaactgcaattcataacgcggagaattggtcatcacctgatattccttcccctcatggatactcagtttgccatccagatattcgatcactgccgtgttacccgtttcatcggtaatagccatgtgcaaagtagattccggtcccccgttcggcatacggggagcgtcaatgcggaaagtctcttttttcatttcatctaccgcttcacgcaccgttgcaaaattgtcaagtacatattgagtccagatactgattcccattgccggacgggtatctccgggaagtgaataaacagattccggcaggaaaagcaggcttgccaccagccctttttcattcattccgtcacaagtacctatatcatagcctgttgcgattacgcttccatatttggaagtccagtttactgttttttctttattgtgtcccgcacgctgcattccacgtggaaacacatagatattcgacatgatgtcttctttccagtccatcgtgcgaccagtgaccaccattccgtccggtcccagatatacggcacgcgtacatgcttccgccggctgtatgcccatcaaagagacggcagctaacaccaatgcaacacccgtaagttttttcttcatattccttccaaattaaatagttgatactcttatatctataataacaaatatacaacgaatattgcctgagagagagaagaatttaagggaaaaaagggaatttattcagaaaaaatcttatctgctcttatttgagttaaaaaagcctgcggatggaaggaaacattacacattatttgcttttcaaatgggatttcattatttttgtacataacctatcataaaaactaaggagggcaaatgcgtatgagacaaaaagttagcatatcacggcttccaattcgtttgggaatctttcttttgctgtattttgttccgcagttactctccgcgcaagaaaacaacgacagcacgcacatacttcgtaacggtgcatccataacgccggacgacgtacttaaacaggccaacattaacttgtttccagaaaagagcactacatattctttatattcacccggacagttggagcatataccccgcttttcactcaaaagggatatttccctaccttatcagaccaatccttccctactcttccgaggtgattacagcacgggcggggtattgcatcaattcgatcatggagcactgttcggttccggaagccagacaagtatggcaggcatcgggcgtttcaacagtgcttcactaggttatcagcatattttcaatgagcaattcgagttacaagtccgtgccaatgcgctgaaggtcaacatgtcccatatcaccggacaggctttcagcacttcgggcgccttcctttatcatccttccgaccatgtcaccttcaaggtcttcgggtcatacgacatcggaaattcttacggaatgagtacccatagctacggagctacgatgtccgtcgatatgtccgaccgcttcgggatggaaatgggagtacagcgatactatgacgcgatgagcggacgttgggaaacggttcccgttatgattccttactaccatttcgataagttcacactgggtttggatgtgggtggtattatatatgagattctccgcaatgccgtttttgataaaaacagaggtataggtggtccatccggcccgacaatcggaccaccccggatgcatatacctatacggtaaaatcccgttatcataatactggtttacatagatcaatcaccagtttcgacctttgaaacttttagtttcaagcgttggaactaatagtttcatgccttgaaaccattggtttcaaaggttgaaaccaaaagtttcaagcgtctgaaactatctgaatgtactgttgatttgattgacttgactgcacgtttcaatcacattaaccatatcagttattccgattgagctgttctcttaggaagcataaaatcaattattggtcaataatacatgatttctcagtctttaatacctgatttctcagttattaatggttgagaaatcaaacgttaataactgacacatcagacattaacatcctgtaaatcaaaagataacattacaaaaacgatactaatcaggacgagacagagtgagagcaaccgtttgctctcatacttgccaccacgcttgctaccatccctgaaacatcgatgaataaagggatacaagtggatagtgagagcgtgatagcaaaacggctatctaattccttatggtgcgaacagaaaagaagggactctttttctttgaaaaaagagaaatcactgttatgtgagacactgtccacaaactattcgaaattctttcggtaagtacatccatttctccattccgaacatccgtaagctgtcttccctttaatgatggttcccttaccacaaaccggacacggttgtccgacaaaagtatctgcattaccggtagccggagcagaggcaggagcagaaggagtcagagcaggagacggagaagatgcaggaactttcggttctgctttcgccttcttttctttgggagcacttgctttacgctcacgcttcttaggttctttctttgccttttcttccgtttgggcaactgcctcctgaatagtgatacgtcggttcgtattatctgaaagtacgctcatcacgatttcagataccatttgcttcagttcttcaaggaattgacgggcatcgtatgtcttcttttcaatctcacgtagtttcttttcccatataccggtcagttccgcagatttcagcagttcttcgtggatgatctgtaccagttccactcccgtaggggtggctatcaggttctttctttccttgcggatatagtttcgcttgaacaacgtctcgataatggcggcacgggtagacggccgaccgataccattctccttcagagcatcacggagttcgtcattatccaccaactttccggctgtttccatcgcacgaagcaatgttgcttccgtataaggtctgggcggttgcgtccacttctcattcaagtccggaacatgaggaccactctcccccttgacaaaggcaggaagtacattttcatcctcttcctctttttcttcggaagtatctttcacatctttggcaaaaacgacgcgccatcccggctccagaatctgtttgccggttactttaaattctatcttgtccacttcacccatcacggtagtggtagaaatcttacaatcgggatagaacaccgctataaaacgacgggctatcaggtcatagacacgacgttccatatccgtcagattctgcgcataaacgcctgtagggataatggcatggtgatctgttaccttcgaattatcaaatacctttttcgatttaggcaatgaagcacccgccaaaggagcagtcagcacctcgtagtcccgaagacctttcaatattccgggacacttcggataaatatcgtcactcaggaaagtagtatcgacacgcggataagtagccactttcttttcataaagcgactgaatcagcttcagcgtttcatcggcagaataggcaaacttcttattacactctacctgaagagaagtcaggtcgaacagacgcggagcatattcctttccatccttcttgccgacattggtgacaatgaacggaaggtcctttatgcgttccaccagcgcttctccctcctcccggttggcgatagggtcgatgccgggattgtctatcttcttctttccgccactcttttcttcttccgcagcaatttcttcatcgcttttacggatcagagcagaaaaggtagtatcacgataattcgttttcagttcccagtattgtttcggctggaagttggcgatctccaattggcggttgacaatcaatgccagcgtaggagtctgcacacgaccgatggaaagcacttgtttgttctgaccgtatttgatggtataaagacgggtggcattcatccccagcaaccagtcccccattgcacgggaaagtcccgcttcatacagtgattgaaaatccgactggtctttcaacttcgcaaatccttcgcggatcgcttcttctgtcagcgaagaaatccaaagacgtttcaccggacagcgggcacctgccttctgcatcacccaacgctggatcaattctccttcctggccggcatcaccgcagttgatgatttcatccgcgttctgcatcaatccctcaatgatgtgaaactgtttttcgtaagtagggttctctatcagcttgatgccgaaacgtggcggaatcatcggtaaactacccaagttccatgatttccagttaggagtgtattcatgcggctctttcaaggtacaaagatgaccgaatgtccaggttacctggtatccgtttccttctatatacccttcttttcttgtatgagcgccgagtacttcggctatatcacgtgctacagacggcttttcggctatgcaaactatcattttttctcttcttgtttttatactaacagtctacaaagttacatgattatttctcactgaccgcataaagatgaaaaaaacatcccgccttcagcccgaatggagctataaggcgggataaaaaaaatagaaaaaatgattaaattccgtgtttattcttcatccatcaggatttccagaatctggcaagcagccttcgctaccggagtaccgggaccgaaaatagcagctacacctgccttatacaggaagtcataatcctgtgcagggataacaccgccggcaattaccacgatatcttcacgacccagctttttcagttcttccataatctgcggaatcaatgtcttgtgtccggcagccaatgaagaaacacctactacgtgaacgtcgttttctacagcttcgcgggcagcttccgccggagtctggaacaatggtcccatgtctacatcgaagccacagtctgcataaccggttgctaccactttggcaccacggtcgtgaccgtcctgtcccatcttcgcaaccataatacgaggttgacgtccctctttcttagcaaacttctcagccagttcacatgcacgcttgaagtcgccatcgtttttactttctgatgaatacacgcctgatattgttctaattattgctttataacgtcctacaatcttttcgcaagcataggagatttcacccagcgttgcacgaacacgagcagcttctacagccagttccagcaagttgcccttaccggtctctacgcattcggtgatggctgccagtgctttgtccacttctgcctggttacgtccttctttcaaacgtttcaggttctcgatctgttcaagacgaactgccgtgttatcaatctcaaggatatcaatcggagcttctttttccagacgatatttgttcacaccgacaatagtctgagaaccgctgtcgatacgggcctgcgtacgtgcagcagcttcttcgatacgcatcttaggaatacctgtctcgatagctttcgccataccacccagtttttctacttcctcgatacgttcccaagccttgtgagccagttcgttggtcagagcttctacgtaataagaaccgccccatgggtcaacgttcttacagatataggtttcttcctgaatataaatctgagtattacgggcaatacgtgcggagaagtctgtcggaagggcaatagcctcatccagcgcattggtatgcaaagactgtgtatgtcccaaagcggcagccatagcttcgatacaagtacgtcctacgttattgaacggatcttgttctgtcagcgaccagccggaagtctgagagtgtgtacgcaatgccagtgatttcggattcttcggattgaattgttttacaatcttagcccacaacatacgggcagcacgcatcttcgcgatttccatgaagtgattggtaccaatcgcccagaagaaagacaaacggggagcgaacgcatcgatatcgatacctgccgctgttccggcacgcagatattccagaccgtcggccaatgtataagccagctcgatatctgccgtcgcacctgcttcctgcatgtggtaaccggagatagagatagaattgaactttggcatcttctgcgaagtatattcgaagatatcggaaataatcttcatagagaatgcaggcggatagatataagtattacgcaccatgaactctttcagaatatcattctggatagtaccggccatttcttcgagtttagcaccctgttccagacctgcattgatatagaatgccataatcggaagtactgcaccgttcatcgtcatagacacggacatcttgctcaaaggaataccgtcgaacaaaactttcatgttttcgagtgagcagatagatacacctgccttacctacgtcacctaccacacgttcgtgatcggggtcataaccacggtgagtagccaagtcaaatgctacggacaaacctttctgaccggaagccaggttacggcgatagaaagcatttgattcttcggcagtagagaatccggcgtactgacggatggtccaggggcgaagagtgtacatcactgaatacggaccacgcagataaggaggaagtccggcagcatagccgaggtgttccattccttcgaggtcctcttttgtataaacaggcttcacatcaatgtgttccggtgtattccagtcagcggaaataccgttagccttttgccattcagcaccgttagcgggctgaaatgcagcatatatatctaagtttttaaaatcttttctcatcttacttcaatagtttggcgttaaactctttcaaggtatccaatacgttgacacgcacgtggatgaagttctcgatacctgctgccttcagttcatccatacaagcgggagcacctgctacgataaacatagcacggccgttcaatgcatggtatgccggaaccgcatattccgcatattcgtcatcgcttgaacagaggactacaatgtcagctttagcagccatagcagcttctactccggcttccaccgtttcgaatccgagattgtcaataacttcatatccggcacaagcgaggaagttgcaagagtattgcgcacgtgcctgacgcatagccagattaccgatagtcagcatgaacgctttcggacgtttgccggaagcctccgtttcaaggcgtaatgcctcaaattcgctggctgcacggtcgaataccaaagtatccacatctttctcgcaagtatgagcatcacctccgcagcagcattttgcttctatcggctgtttctcacctgctttttcattgaagttcgggaactggttggtacccagcagcacttcacgacgttgagcaactgctttatgacgggccttgttgctttcgttcactgctgcctgaactgtaccggctttcaatgcagcatagaaaccgcctgcctcttctacggcaaggaagagttcccacgcctgtttagcgatagacactgtcagattctcgatataataagaaccggcagccgggtcaatcaccttatcaaaatgagattcttctttcagtaacaactgctggttacgtgcaaggcgttcagagaattcatccggagtcgaataagtcttatcgaacggaacgactgtcattgaatccacaccggccaatgcagcactcatcgcttcagtctgtgtacgaagcaagttcacatgagcatcaaacaaagtaagattgaaagtggaagtttcggcatgaaccgccatcttcgcagcacaacgacattctccattagcccccttattgtcgcaatcacgcaggcattcaggatggtaggaagctacgatgtttgcccacagcatacgtgctgcacggaatttagcgatttcaaggaagtagttggaactgataccgaagttgaacttaattttcttggcaactgtagcagcagggatacctgcgtctgtcagctggttcatgtattcattaccccatgccaatgcatagcccaattcctgagaaatgtaagctccggcattgttcagcgagattgcatttacattcagtacacgatagaaaggaagcggttggatagcttcgatcagggctttggcagtttgaaccatatcgcctttttctttaccgcgagtcagcatcttgttaaagaagtcataattgacagaacctctcagtttcttcacgtcataatccttcttctggaaataagccaccagcagaccagccaattcaaccacatgtccctgacaagtagagaagttcagttctacacactcagcctgaataccattcaacagtgtttcaatgtattccgcattgagttctttcgcttttacgtggaaagaaagtgaatccacacctttgttcagaatatccagtgctttggcattggcttccttcggacattcaactttgatttcctggcgaaccagccactcattattgctcttcttggtgcctctcagatagggaaattctccgggaagtgcatctgttgttttcaaaccctccagatcttccatccggtagaaaggtttcactttgaacccttcgtttgtcttccaaacgagcttcttctcaaaatcagcacctttcaagtcggctgtaaccttctccatccattgttcggtggagacaggagaaaagtctgagaagagtttttcttttttgtctgccatagtttatttaaaattaaaacaagaattaatattgtctttatttttatttgtctctttctaaatgtcagtcgttcgacttgcaaatataattaataagttcgaacgattcctctttttagaaaaaattcgcactacaggttacagagagaaaatgaagaatgataaactatagaatgaagaatctccatgcaacttaaagctaaacgaagcaaattcctcattcttcatttttagttctccttttatttgattagctccgatgtaatgagtaattttgcacccgtttttaaaagaacattataaaaactactaatatttatggattggttacaaagtttattgtgggaccctagctccgtagcgcacattgtattcctctacgcttttgtagtggcagccggtgtgtatctcggtaaaataaagatattcggagtatctttgggagtcacttttgttttgtttgccggcatcctaatgggacatttcggcttcacagccgatacacacatcctacatttcatccgagaattcggattgatcttgttcgtattctgtatcggtcttcaggtggggccatcattcttctcttctttcaaaaaggggggaatgacattgaacctgttggctgtaggcatcgtagtgttaaatattgctgttgcattggggctttattacctctggaacggtcgtgtggaactgccgatgatggtaggtatcctctacggagctgtgacgaacactccgggacttggtgccgccaatgaggccctgaaccagttgagctacaacggaccgcagattgcactgggttatgcctgtgcgtatccgctgggtgtggtaggtatcatcggttctatcatagctatccgttacatcttccgcgtcaatatgaccaaagaggaagagagcctgaaaactcagagcggagacgcgcaccacaagccgcacatgatgagccttgaggtacgcaatgagtctatcagcggaaaaacactgattgaaatcaaagaatttctgggacgcaactttgtttgctcccgtatccgtcacgaaggacacgtaagtattccgaaccacgaaacgatattcaatatgggcgaccagttgtttattgtctgttcggaagaagatgctcccgccatcaccgtatttatcggaaaagaagtcgaactggactgggagaagcaggatcttccgatggtttcccgccgtattctggttactaaaccggaaattaacggaaaaacgctcggttccatgcacttccgtagtatgtacggtgtcaatgtgacccgcgtcaaccgttccggtatggacctgttcgctgatccgaacctgatattgcaggtaggtgaccgcgtaatggtagtaggtcagcaagatgcggtagaccgtgtttccggtgtattgggtaaccaattgaaacgtctggacacaccgaatatcgttactatcttcgtaggtatcttcttaggtattcttttaggaagtcttccgattgcattccccggtatgccgactcctttgaaattaggtttggccggtggtccgttggtggtagctatcctgatcggacgtttcggacacaaacttcatttggtgacttacaccacgatgagtgccaacctgatgctgcgtgaaatcggtattgtgctattccttgccagcgtaggtatagatgcgggtgccaacttcgtgcaaacagttgtagaaggcgacggcttattgtatgtaggctgtggtttcctgatcactgtcatcccgttacttattatcggtgcaattgcaagactatattataaggtaaactacttcactctgatgggattgattgccggtagtaatacggaccctcccgcactggcttatgccaatcaggtgacatccagtgatgcaccggcagtaggatattctacagtttacccgttatctatgttcctccgtattctgacgggacagatgatattactggcgatgatgtaaagcgaactaaattaatcaataaagccggctaaattctttctgaattaggccggctttattattatcgggattttgttttcttcttcaattacaatccaatctgtagttttttggccacaaactcttccacaaagcgaaccgtctcttcaattcccaaagaagaggaatcaacacacaaatgataagtagccgctgctccccatgtcttataactgtagtaattataatactccgaacgtctcttatccgctttttctatcatctcttccgcagcctcctcatcaatacgatgcatctgacacaaccgtgcgatacgatcttctttagtagctgagataaagacatttgcacagcggggatgctcccgtaaaatataatcggcacaacgtccgacgaacacacaggacttctctgccgccaaacgacggatgacatcactctgcaccttaaataaagcatcattactcagacaattggtacatggcattgctccttcactgatgaaaggaaaacgcataccgaacagtccgccgataatgccttgcgaggccttttcatctgctttttcgaagaactccttacataagccgctctcttcggaagccagattgatcagttccttatcataaaagtcgatccccaaacgggctgccaacttctctcctatttcttttccgccgctacctaactggcgaccgatattgataacataattaccgctcatagtacattttgttttatggtttgatagcaaacatacgacttttttctaaaagatgcaccattatacaaaagttatatttaaaagaaacaatcggaaagcatcctttttcatatatactctgccaataatacatctacatggtacgggagtccggctgtcacccgcctattttttcttcttaccccacttgggagttatgccgataaaaaactcgaagttaattcccggcatcggacgggataatactgaaagatactcttcgtcaaagagattattgactgtcccttttaaggataaatctgcccaacggagagagaatcctttttcaagggttacgttgctcatgagataaggtgggagatgtccggtgtaggatacagcattactcgtcatagtataacgttcgctatagtaacaccatttataaagaagtccccaactgcgatatgttagcctgcctgataatgtagctgaatattcgggtatgtatggtaactgcttccctactgactggtcagcctcactcgtaggttcaccttcattaatagaaggagtccacgcaaatgttccatttaacccaagcttccatgctttattaatcgcaactgcacaatcagcctgtacttctacgccataggcgtgtacttttttaagattaacgggtgaataaaatcccttcgacgtaggtagccaaataatccagtcgtttatatgttgatcgaaccaagaagccgagccggataatgtataaacattatccttacccacagaaaacgacagccccgtttcataagtaaatccactttcattgttcaatgccggattgccacccggcaaaaaataaaggtcattcaatgtcggaaaacgataattccgggtaatagaagcctttgccattatattgcctcttttagaaagaacataatctacaaaaaaggcaggaataaccggtgcccatttagtcccgaacatctctccccgcaggaccaatgacatacccaaccgattgaccggctgccatttcaatgagacattgcccgacaactcaatacgtcctttatcaaaataaacaatagaatcattcttccttccctgaccatacttatcgttcttattatcatctttattcagatctttatccaaactattcaccaaatgctgatgagccgacacacccaccgttaaaaggagtttatctgagaaaaaatactctccatccaactgtccgtagaaagtattaactttactacgtgaacgggtcattgtagccattataccatttcccaaatcccgcttatagtcgtatgccaaccatgtatgcacataacctccccttgccgatactttccagttctcacgtgtatgatcccatgataaaacacttcgcagtgtatgttcccgttgacgattctcgaaatccataagatcaccctgatcggtcgtcagtaatgccagttcacggttagaatcagtataccacgcattcagtccgaagcgatcacctttgcccgtattgtaatatacctcctgtaaaatgtgcagatctttgtatgcaccactacgattacgttctatgggataatactgttcgattatattatatttatcatcataaatattctctttcttatcatgattacgatatttataatcattgggcgacgactgatagaccgcccgcgttgaaacctgccaatgtttatctccatacttcaattgcagaaactcatcgaaggtactaaatgaaccgataccttgaacatattgcattccgaagccttcttgatgagcaggcactgtagataattttaccaatcctcccaaaccaccaccagccatattcaccgacgaagtgccatgcagcaaagaagcgtcatctataaaataagatggaatcatcgaaaagtcagtcatccccaacatcggattgttgatacgcataccgttccatgttacctgtgtatgcgaagcagacgttccccgaaatgaaacagtagaaagcgtggcacgtccgtagctttttacaaaaatagaagaattgaaagtgagtatatccgccattgacaaggctatattttccttaagcacaagtgaatcaaatttggtctgttgcacgcctatatctttcatcgggcgctttcccaaaatttccacttcacgaatgacaactcccttttccgcccaattcttattatcgttgtgttgttgtccactcattatggatggaagtaataaaagaactcctacaaactgcactaataatatatttcttctcatgttcttctctaccgattacttccaacaaaatgctccaggaataattcctacataaaactcatccacaagttccccatcctccgtatagcgataaatcatcccctgctgttgataatcaatggcgtcagccacatagacatctccgtttttcggactaactgtcaacccataatacttcgtatcacgatacttgaggaaaggacgtacgggaacacgttctgcatcgacagacatacgccaaatatctttgttaatccagtaaagttcatcacccgcaccattaagctgtacttccgaaggagcatctcccaactgaaacttaaattgtttctctattttaaatgtctcggcatcaatgcgataaagcgatggttcctcatatccgtatggacttcctttataccctccgtcagtaatcgtccacatcttgaagttcttatccatcactagagaagtaggttgtatacctacagtaagctgatctaccaccttgtccgttgtagtatctatctttaatatacgattctgataagaccagcaattcacatacacatacttgccatactgcaccatttgctctgttgagcctgtttccatcgtcatatccggacattcgatatatccggttatctgataagttttgggattgacaataaaaatacgataatcccaaatctgtgtgacataggctttctcatccgaaataaaatgaatatagcgtggagaagtaagtcccgtaatgcgtcccacctctttgaatgtattggtgctaatagcgaagattacatgagaattattcactaccacccatccaatagtatcccggacaatcattgattgcgctacatcacccaacttcatcgcattagcccggtaaaagatctcattctccacctttttcgtttccggatcataataagataatgtagcattaccgtattgaaaatttccctcattcataataaaaagtccatctcctgtagccctgaaaggctccatcttgccataatcccatttcatacacccgacaaaagccgtcagacagaagacaataaataaaacagatagtaaaattcgtttcataattaaaagtgagaaaagattattaactaacttgtagcatcactcattagacatctgccagcaaattataatttgtgacaaacatcaaacatagcatttgtaccgaccggttgaatgaggaatcaattgaatataggaatgaactataccagttgatttctacccgaaacccgcgggtataaatctgcagcgtcaaggcaggtcttctgactcgtccccgtttatcacgccttcccagtgatgtcaccagtggcaaagaatgtgataaactcatctcccgaaagagaggacttacagcagcaggtactgtcccggatttacaccggattcccttttcatcgttttggaaggttagacaactccaaatacgaaccttgcgggtgcaaagatactataattatatttcacgcctcacttctcccctgtcttttttatcaagaacaaaagattaaagacttcttcaaattagcacattatgagcaagcagatgaaaaagagaaaagtttgccctctgttacttcctatctttcggataaaaaccggatgactcatcaaaaagaggaggaattttcattttcacaaaagcgatttaatatcaaaaccatctatttacaatcattctagcttagaatacaggaatatgcaagcactcgaaaacaaaagaaaccatatctacgtcattttatcataaacaaagcatccatatcaaaagagcaaacagcgcaaaaaagcataataacggacaaaataagattgcttcttaaccgaattaacattgctttataagcaaactaagattggttttaaaccaaactgaccttcctttaaaaccaagcccgccttcctttaaaagaaaatcaaccttcttggtcggcaaaagctgcatatataaccatttttcccgcataaaaacctccaatttccgcatattcttgcatatgagtaacccatttttctcctatttcaagtatttagcttctatttccccaatagaaaatcttaaaaacagaacattttgagatggtatcactataccatcggcatactgacactatcctgcaagtatggtgacactatcagagagagatagtgtcaccatatccaattcctcctttcccgcctccgataacataataaaaattaattagttaaaatagacatattatataaaaagataactatctttgcggtcaagaagttggttcttcgttgctataataagttgtatttcattcgattaagatataacaaaagctatcgaagattaaaagggaatgccgtgtgaatcggcaacagtatccgctgctgtattttcccgtactgcccttgaaggacagtacagtttgtagcaatttgtcactggaagttttctctgggaaggcgctgcaaataagggaataagtcagaagacctacctcctttcggttggattttactcctgcggcatacgggagacaggtcgttgtcattttccacaggcactcatcatgtgcggacgaggaaaagggcttcttctatatttatacttaccgggacacagactgcccagcgtaaaatccattatcatttctgtttgcaaactaactaaaaagtatgcttatgataaatggattttttaaaacaatcgctagcttattaatgctatgtgccgtcgtatctctcgcctcctgccggaacgacggtgatgatgaagaactgggcggcgggacaacaggcaccccccctgtaattaccttcgacaacggtacgggaatctacaccgtaaagatcatgaaaagcatcaccatcactcccgtagtgacagatgccaccgaacctgtatatacatggaaagatgaaaaaggcaagattgtctgtacagacctctcatacacctattcgcccaaagcagaaggggaagtctacttcaaattccgcgtagatgccaaaaacggctcttccgaagaagaattacggatagatgtagtagaaaagatgattccttccgtgtcactgatccccgcctactctacgtatttaggaaaaagcgttaccctcgaatcttccgtcaatttcactgaaggagcgaagtacgaatgggtgtccatcgacgaaagcggcaagaccaaagaaactgtcggcaccgaagctacctacactttcacccctgccggagaaggacagttcaacttcaaactaacagtcaccaacgaagacggcagcggaaatgcgacgacctccgtgctggtatcgccggcacccgtgatgaacatcaccttcagcagtgagcagctgaccgtccccaaaggtcgtgccgcctgtatatctcccgtcattacggatacgacgtccaacgcaacttacgtatgggaagtagacaatgtaatgcaacagggagcgaccgcccccacctttactttcaccccgccggcagccggcagttatctggtgaaagtgaccggaacagatggtgacgtagtgaagagcgctacccagacagtcatctgcctgactaccgacgaggctaaaaactacaatccgcccacggcaagcagttcggacagcaaagtaaaagtatatcatctgcgccctgcccccggacagttcatcgcacaaatatccggacagagcgaagctgaagcatgccgctatgccgaaacccgcatgaatgtacagaacaattatgtatcactgggtgcatggggaggatatatcatcgtgggattcgaccacagcgtatacaacaaacccgatgtaaacggtaacggaggatacgatttctctattataggcaatcccttcgacggtagttccgaaccgggtatcgtctacgtcatgcaggacgaaaacggagacggactgcccaatgacacttggtacgaactacgtggcagcgaaaccggaaaggcggaaacctatcaaaactatgccgtcacttattatcgcgcgcctacacacaacatgcccctgcaatggatcgacaaccggggaaactccggctccatcgacctcaatcctaacttcccgctatggataaaggaaaacaactataccctatacggtacccgcctgaaacgaaatacaacccggacaccgggcggaatctggcgcaatgaatcctatccgtggggatatgcggacaactggggagaagacattctcgccgaaggcgacaatcacgatgccgcacctgtaggcaacgccttcaagatagaaaacgccatgtatcccgacggcactccggtcaagttgcaatacatcgacttcatcaaggtgcagaccggcatacaatccgtagcgggagctatcggagagttatccaccgaagtattcggcttcgtcgattataagatgagcgaagctccttcaaaaatagattaataattattcattataaattcatttaattttttagacaatgagaaaagtaaattactggaaaaccctgttgctggttttatgtaccggatgtatctttgcagcatgtagcgacgacgacgatgaaaacccgttcaccggagtagacaacaacttccttagtttttcactggaaagcaatgaaaacgtatggaaagcaacgattatagacaatgagatcaccgtaacggttcccgaaggaacttcgctcgatggcgcgcaagccagctatacccttagcgagcaggcaactgttaaccccaacccttcttccgttaccgcctggggcgaagagcaacaattcacagtaacttcctacaacggaactacgcgtacctataaatatacagtacgctactccgctgtaagtgaaatcggcacattcatacttaattcgcaagctgatgtagacgcttttgccgaccaccatgtcacggttatcgaaggcagtctgagcatagctacagtagaaaatacagaagaccccgtgattaatctgaacggattggcaaagattaccgaagtaatggacgacatcactatcgggcaatactataaaggtgaaaaccttgccggactggctaaactggaaaaggtgggaagtatcagcatgagaaacaatagctcactgaccgagtttgcactcccaaacttgctttctatccgtggagaactaatcatagaaaacccggcagagaacaagatcacttctataaaatgcccgcaactaactacaattctaaaacaatgtaaaatccaagctcccaatctgaaaagtttaaatctcaattcgctcgaaagcattccgggaaaaggagataatagtgatggagatggtacattctctctttatggtagccagcttgtttcattagatttgccagccttaaagcaggtagaaaaagagttcactctaccatcgggaacaaaacacccagaactcacccaaataaatctgccggaattaacctcctgtaaagatgtatctattggatctgcggataagttagaaacaatcagtcttcccaaattatccaatcgttcttcttttagcattacttcttgtgctaaattctctaagttgaacgaaaccatcgcaccgttcaatttggaaaagctaagtttatcgaattgcccaagcgtaacggaattggatgctagtcaaaaagacatcaacagtatttctatcacttatgtcgataataatttcgttctaaaaggaaaagaagaaatgggaagttataaattcacaggatatcaactacccaaaacagaaggtatttctacttttgccagtctcacggttaccactccgcttactaatgtagaaattcccggtattaaacaagttacaggggaattaagtttccaagctacagcaaatgtgacattgctgtcagtgaatatgcctgatttagaaactgtaggaacttttttatctaataataaatacaccaacgtctcttttccaaaacttacgaaagtgacggagcaattacaaataaatataagtagtacagcaaccgacttgtcacatctagattttaaagccctgaaattcgtcagttttttatacctgagtggagctccaaatagcaaaataatatcacttgacggttgttttccaacattggaaacattaagtcgcatacaaatctcctatttgagaggattatacgatttcagcccatttaagaaatttgcagatactatgacagaaaattcccaatggactgtacgtagttgtggtcctggaacagtaacattacaacagatgcaagaatcagaaaccggtgattttacaccggataattaatcacttaataaattacaattatgaaaaaaaacatttttttcttagcagccagtgcaattctatttgcaatgggtagttgtacaaatgatgtgttggacaatgtccaacaagtagacaattctcttcctcagacacgtgctacgacgagtaacaactggacgtatgcgtatgtgcttagcgaaggtacatggcatgtaactcctccctcatctccgggaagtattgttcgttatgacaataattgggtagaagaatcaattcttgaaattggagacacaggcaacgatctgatccaatacggagacaaactatattgtgccgtaagcggacatgacctaacagctaacaacggaggcatttgggtattaaacgcaaataccggagaagtaatatcttcaggtatgattacttatgacgaccctaagactgagcacaaagcaatgccaagacatctagccgccgctgccggaaaagtgtatattagtctttattcgggagcagtgatgtctatcgacaccacctattacaatcaagttgactacaaaatactggatgcgacctattcagaaggtatctgcatcggcatagacaacaaagtgtatgtctgcaattcaggcaatgctgatgatacccaagctggtgaaggaacaactatttccgtattgccactcacccttggtagtgaaactcaaattaccgttcctaaaaatcctaagttgatagcagcttattcagccaataagatgtactttaacgtactgggtgacggaggtatgcactctgcattgtacaaattcaatccaactacacccaatgtagctccaacattagttacagaaaaagcaggtggatttgcaatcggcagtcaatatctttatacggcagacattgattggagttctacttcatacgaaactattatgcaaaaagtacagttatcgaatgatgcagtcagcatcttcactagagactctggttatcaattcggtttcagcgtaacagtcaaccctttcaacggagatgtatgcttcggtcaatcaatgggagacgcattgtatgtttatgactccgcaggaggtgattacaaagatatggtaaataccggcacagctaatgtaaacgccgtagtcttcgtcaaataactttccgcatcaatactgaaaagttagattcaatccattcacctcccagcgaaactttctcgtaagggaggtgaattttcttcttttttactacttttgtcctcagataaaaacatccgtatgaaatttaaatccattatttcaactatcacgctattatgcctcctttctttggcaagctgcgtatacaataaaacaacttctttggaagcattcaagcaagacgtatacacgcccgaatatgctaccggattcaagatactgggcgcaaagaatgcccaaagcaccttgatacaagtatccaacccgtggcaaggagccaaggatgtaacaatgtcctacttcatctcccgcaatggtgaacaggcccccgcaggatttaccggaccgaccatccctgccggagcccaacgcatcgtatgtatgtcttcctcctacatcgccatgctcgacgcactgggacagatgaaccgcatcgtcgccgtatccggcatcaattacatagccaatccctacatcctcgctcacaaagattctatcaaggacatgggtcctgaaataaactacgaactgttactgggattaaagccggacgtcgtactgctatatggcatcggtgatgcccagacagccgtgacagacaagctgaaagaactcgctatcccttatatgtatgtaggagaatatctggaagagtcaccgcttggcaaagccgaatggctggttgccctctccgaactgacagacagccgtgacaaaggcatcgaagtattcagtgaaatccccaaacgctatcaggcactgaaagaccttaccgcatccgtagagcatcaccctaccgtgatgttcaacaccccgtggaacgacagctgggtgatgccttccacccagagctatatggcacaactggtcactgacgcaggagccgattacatatataaggagaacacctccaacagttccgcccccatcggcctggaaactgcctacggactgatacaaaaagcagactactggatcaatgtaggcacggcatccacactggacgaactgaaaaacatgaatcccaagtttgccgatgccaaatctgtccgtgataaaacagtttataacaacaacctgcggataaccgccacaggaggcaatgattactgggaatcggcagtcgtacgtccggacgtcgtattgcgtgatctgattcatatctttcatcccgaacttgtatccgactcaacctattattacagacacttggaatgaagcagcctcgtagacacaccacccttttattcatcactctgggaataatcgccgtagtcttattattaatagatatggcgacaggggacacttatatccccatccccaaagtatgggccgtactgacgggaggcgaatgcgacgagatgacacgcaatatccttctctccatccgctttatccgggtagtagtagcagggttgataggtatcgccttgtcggtcagcggcctgcaaatgcagaccgtcttccagaatccgctggcagacccttatctgctgggagtcagttccggtgcgggactcggagtggcgttgtttatattaggtgccccgttgctcggctgggcagatttcccacttttgcaatccgccggcatcgtaggttcgggctggatagggaccgccgtcatcttgctgggcgtagccatcatcagccgaaaagtaaagaatatactgggcgtactgatcatgggagtcatgataggctacgtagcgggagccatcatccagatattacagtatctaagttcggcggaacaactgaaaatgttcaccctgtggtcgatgggatcgctcagccacatcacagccggacagctgtctatcatgataccgatagtgtgcataggtctgctgctctccgtagcctgcatcaagtcactgaacctgctcttgcttggtgaaaactacgcacgcacgatgggcatgaacatcaaacgctcgcggacgcttgtcttcatctctacggcactgctgacaggaacagtcaccgccttttgcggccccgtaggattcatcggactggcagtgccgcacatcacccggctgctgtttgataacgccgaccaccggatactgatgccgggcaccatgctgacaggacttatcgccatgctgatatgcgacatcatcgccaagaaattcctgctgccggtgaattgtatcaccgcactgctgggagttccggttattttatgggtaataggtaaaaacttgcgtatattcaaatgattcaactcaaagacctgacactgggatacgaacagcgtacgctgctggaaaaagtctccgcccacatcacaggaggacaactcgtcgcactgctcggcagaaacggcacaggaaaaagtacactgctgcgtgccgtcatgggactggaaaaaccccaaaacggagagattatcctgcacgggaacaacatcgcttcactgaaaccggaagaactggcacggaacatcagcttcgtcaccaccgacaaagtgcgcatcgccaacctgcgatgcagagacgtcgtcgcactgggacgtgccccctataccaattggctcggtcaactgcaaggagaagacaaggagaaggtggacaacgctatgcgtctggtaggcatggacagctatgcggaaaagacgatggacaaaatgtctgacggagaatgccaacgcatcatgatagcccgtgcgcttgcacaggacactcctgtcatcctgctcgacgaacctaccgccttccttgacttgcccaaccgctacgaactctgtctgctcctccggaagctgacgcaaaaggagggaaagtgtatcctattttccacacacgacctggacatcgctctctcactttgcgacacaatcatgctgattgataatccgcaactctacagcctgcctaccggtgaaatgattacgagcgggcatatagaaagattgtttcgcaacgagtcaatcacatttgacgcacaggagatgaaaataagaatcaggtaaaaacattcccctaaactacttatttttataagccttcgtgctagttttatttatattttcgactatctttgctcccgaattggtttttgaatagtgatatcgactattcaaatgaaaagggaatcgggtgaaaatcccggacagtcccgctgctgtgaagctccattcaacttcttgatatatacttttgccactgaactgtcatgataaattcagatcgggaaggcatcaggaagggagtcagtcagaagacctgccattcagtttcaaatagctgtttttactcgtggaatagaaaaacggcaagagttattaaataatttacttatggacatactccaatgacctgacatcctccgatgctccggcagtaggctatatattaccatatatccgctgacgaagcttctgtgagtattgacggcacaattgcttattctgtcattgggataatagaatcagagtctgccaatcagctttgatcatgtgattttataagagatacaaaattattttatgtttaactataaaaagaaaagtatgagaaaattattttccgttttagtatttatttgtttgttgacagcctgttcatcggatgatgatcccatctcttatggaaatccctctgtagagttatctacagaagaaacagaagaatttacctatggagaaagccgcgaatttccaatcactctaaaagaagtagcttccacctcttttgaattacccaacggttgggaagccagtattaaagatagcaaactgactgtaacagctccggaaaaagggaaaacaggaatgagtagtaacggtacgattgaaattacagcaaccggtcttaacgaaacaacagttacggcatccataaaggtaaaagcattctatctgataaccttcgaggatgtagatgccaaatatcttgccggtccgacagcatacggagataatctctacacaaattataccggttcaaccccagaattatataaaggctatcatgacgtatcttccgatttgtttttcaatacgacgacccaaggatatggttttgcatccggaggaattgccatctcgcaatggaataacaagacaaaagctgactatatgaatcaatgcagcgttttttatggagacgataatcaaaagaacggaggaaataacggctcagcaactttcgctgtaagctatgccaccagttatggtacatcaggagcttatatgtatttccagacagaagaagctgagtacgaaatagaccatgcctacattactaacaacacttatgcagtactatctatgaccaatggagacggttttggaaaaaaattctcctatgaagataaagattggttcaaactcacaatccaaggtgttaatacggcgggaacaattacaggagaagtcgaattttatctggcagatttccgtacgcaagatgcagccggcattcttactgaatggaaacgggtagatttaacaccactgggcaaagtacaccgactcaattttaatatgacaagctccgacggagaaggaatgtggataaacactcccacttatttctgcgtggacgacattgccattacatattaaaaatttcatattccatatcctgattaaacaaaaacaaacaggacagataaaaattaccaaatggtaatttttatctccttccatacccctacctttgcagccgttttcaacaaactaaagataaaaagtcatgaaagacagtattgatttcggtagtatggacatctctacattgttccgtaagttattaattcctacggtattgggaatggtgttctcagctatattcgttatcacagacggtatattcgtaggtaagggaattggcagcgacgcattggctgccgtcaatattacagccccgctttttatgattgcagcgggcatcggactcatgttcggaatcggaggatcggtagtcgcttccatccatctgtcgcaaggcaaacgcaaggcggcaagtatcaacattactcaggcacttgtattctccgcattcatcgtattagtcatgtccgctttatgcttttacttcgtagagccattaggacgcttactcggaagttcagaaagactgttgccgcttgtcatagaatatatggtctggtatctgcccttcctcgtattctacgaattgctgggcacaggtatgttttttatccggctggacggatcgcccaattatgccatgatatgtaatgccgtcgcagctatactcaatattatattagactatatattcatctttgaatttggctggggaatgatgggtgccgcttttgccaccagtctgggaacagtagtaggcggattgatgaccgtaatctatcttacacgattctcccgcaacattcacttgtatcgtatcaagctaagtttgaaaagcttgatgctgacgctccgtaacggtggctatatgataaaactgggaacttccgcttttatcagtgaggcttccatcgcctgcatgatgtttttggggaattatgtctttatccatcatctcggagaagacggagtagctgcgttcagcattgcctgctacttcttccccatcatctttatggtgtacaatgccatcgcacaatccgcacaaccgattatcagctacaatttcggtgccggacaaccggatcgggttcaaaaagccctgcatcttgccatccgtacagctctaatttgcggaatcagctttttcatcatcacggttctatgccgtcagaatattgtctcgttattcattaaccgaagctatccggcctttgatattgcgatcaatggcattccttattttggggttggattcatattctttgccgtcaatatgataggcatcggttattaccagagcatcgaacgaggccagagagccaccatcatcactcttctgcgaggagtgatattcatgctgatcgggttctttgcacttcctcctgttttaggagtaccgggaatatggctggcggttccgctggcggaattgttaacaactctctatattatcggaatttatttcaaagatcgtttcatggtccaccggcgatgagtatctttgcatcatggatgcattcgttcaaaaactttgcgacagatacaaggtatcggaaagcgacgtacagactttactggactgtatggaggaagtacatttcaaaaagagagacctcattgtgcgcgaaggaacaaagaacagcaatctttattttataaaaacgggaatatggcgggcatattaccacaaagacggaacagataccaccatctggttcgcttcagacggagaagctgctttctccgtctggggatatgcagacaatgcttattcgctgattaatattgaagcaatgtgcgacagtgtagcctacagcatatcccgcgcaaccttgaatcaattatatcattcttccatcggactagccaatctgggactgcggctgatggatcaccagcttcttctgcaagaaaactggcttatcaactccggcagtccacgagcaaaggaacgttacctgactcttattaaggagactccgaagctgttgcaatatgtgcctttaaagtacattgcatcttatctgtggataacaccacagtcactgagcaggattcgagcatccttataatcttcactttttatgggtataagatcaaatatttctctcaaactcaagtgaataaataaaactgtccgcacgataatatcctatattccattccaatggacatccttccggatcataaacaaaccttttacgcaccaaaattggatctccgacctttatctcaagcttaccagcaatgtacttgtcagccagtctggcactaatatcttctttagaaacttttgcaatagcatgataatctctttccaatatctcataaagaggtctggagaaatcctcacttcctgtcaagcctattttaggattaaaataggatataaaatacacgaaagggtattcttgatttccacgtaaacgctctaacttcagtattctttttacatcaggagcattaaaaaaaagggctatatcatctgtaggttttgtccagctaacatgaagttcataattcattggtacaattcccaaagttttcatttcctgtgtgaaactcatccaattctgagctttggaacatacagctgaatttacaacaactgtacctactccctttttcctcatcagtaatccttcgttcacaaggttattaatcgcctgtctcaaggtattacgagatatgcccaattgtttagacaaatcaatctcatttggaagcattttaccttgtttatattcctcccctttgataatagtcctcaactgttcttcgatctgaagataaagggggattgcgctgttatggttaactaatatcttcatgattaacttttttacaaagataaaaataaaaataaaaacaggcaatactttttgttcttttcaagaaaaagaatacatttgcaaatgtttatatgttcagacatactaattaattaaatcataataactatgaagtattatttgggaatagacataggtggtacacatataaaaggtggaatcgtcaaccctctaacgaatgacattcatcaaaacatactatctcacgaagagctgaatgccacagattcaacatcaagcatcattacgaaagtcagaaaagttattactgacattcaaactcgtatacccctatctaaattaggcggaatcggtatagccatgcccggtccttgcgactatgccaaagggatagttgccatttatggtgtgcccaagtttcagtcacttttcggccttaaccttaaagaagaaattaaaaaagtatctgacctgaatactgttttcataaatgacgcatccgcttatgcccttggagagtattatgcaggagcagcaaaagacacaagtagaagcattatagtcacaatcggcaccggacttggaagtacatttcttgaaaatgatactgttttgaacgaactgacagaaggaatacctgaacatggatatctctacaacataccttaccgagacggaatggcagatgactatttttcgacaagatggtttgtaaatacatggaatatgctatttccagataaaaaggtaactggcgtaaaagaaatcgcattacgcgcttcgaacggagacaataatgcacagtcattatttgaaaacttcgcttcaaatttcgtagaattcataactccattcctactaaaatttaaaccggagaaactgattataggaggaaatatagcaaaagcttctgacttctttttagataatattcaatctcaattagagaaactcaatttaatcactaaaatagatatctgtaaattatgggatatgtcgccattaatcggatctgctatttacacaagcaacatacttgaaaatatgaaaaatacaaaagagaaaagacacacacagcaatttattgcacccactaactctactgccaccccatcaggcgaatatgatatatatccggcatttccattaggaaaaggcaaaattggaaagggtataaaccaattagcggactggatagaaaaacattcccaaataataattgatggttatattggaatcttctgggatgaattaatcattaagttaggagaagaactcagaaaaagaggaaagaatgtgcgattctttcataccagtgtagcaatgaaagatccactgactattgaaaaaatgattgctccttatcttggaggagataatccgttattcggcaccattactgataagcatttggttaattggtttaatgaaaataaacttaattccatacaacctgacccggaagcagatttaaatatatttataggtacaggagcagccctatctcaatggaaagctcccctgatttatattgatgttcctaaaaatgagattcagtttagaatgcgcgccggagccatcaataatttaggattagattatcgaaaagacaatcaacaggcttacaaacaactatattttgtagactggattgttcttaacaagcacaaaaagcaatgcctgcctctgattgacctacttattgacggacaaagggaatgggatgaactattaatgatttcaggaaatgacctacgagaaggattacacaaaatgagccgcaatttcttcagagttcgtccatggttcgaacctggtgcctggggaggacaatggatgaaaaatcatattcaaggattaaataaggaagtgaataatctggcatggtcttttgaactgatggtacttgaaaacggactaatgctggagagcgacggatatcgacttgaagtatctttcgattttcttatgtatagtgattatcagaacatattaggagaatgttcggaaacatttaagtacgatttcccaatacgtttcgactttctagatacctttgacggagataatctttctatccagtgccatccacgcccccgatatatacaagagcattttaacatgccattcacccaagatgagacatattacatattagattgtaaaaactctccatgtgtatatttaggctttcaagacaacatcgtccctgaagaattccaacagaccttggaacaaagtcaacaaaaagcgacgaaggtagagatagaaaggtttgttcaaaaacaccaagctaaaaagcacgatttctttcttattcccaatggcaccatacatgcttcaggaaaagattgcgtggtattggaaataagtagcgcaccctatattttcacatttaaaatgtacgactggatacgcatgggattagacgggaaaccacgacctctaaacattcaacacggaatgaataatctatattttgaaagaaaaggggaaaaagtaatccaggaattgatatgccatccatatatcatgaaagaaaatcaggagtgtaccatagagcatctacctacccataaagagcatttttatgatgtatatcgttacaccttcaaagaccgtattcaaatgaatacagaaaataaatgccatgtatgtatgatagtagaaggagactccgtttgcattgaaacagaggacggcatgaaacaacgctttaattatgcagagacttttgtcatccctgctgctgcccgatcatatacaatcataaatgaaaaccccgacaaaagaataatgttggtaaaagcctttgtaaaagaagaaattactttgaaataatgtcttaataaaaacatcttatccagctactatgaaacgaactattttacaaattatctttttcatatattgtattgcgaatgtatatccacaatacagcacaatctggcaacttggcaaaacagataattcattcaaggagtttgccttagcaccggatggaaaagatcgatttattatctccggctttggggataataaaaaatatttttatgcaggcgaacacacaccggccgattttccatacattataccgggacctacagcagaatgggctggttcttcttactgggcaggacaatgcaggatacaacttcctattttaataaaactatccgatgtcaatccgctaaagaaatatcaatggaatatttttatagagaatgtagaatacgaagactgtatgttcttaagactggaagtcaacggaaagaattacgattctcctatacagcctgccaccaaacagctaacatattcaatacagcctggaaatctaaaggaagggtacaacaagattgtaatgcaattattcaatggtaaatccctaacttttgacgccatttgcctaaacggacctcaagagacacaaatcaataagataggtgatactcctattatttcaatgaaaatggctgattatgaattagaacaagggaaaacaagaacacagcctcttctactgaaaactataactaaaaaatccagaacacttaaaatacaaatcaaccaaaaggaaatattcaaacaagtagaagaaggggagaatatctacgaaattccaaccggaaagcttaaagaccagtctaaaatcaaagttaaaatatcaacagaaggacaagtagcaactcaagaatttatccgtagtaaccagcgactacgcagatcaattgattatgttgatcagtttgccggttccagtggttcacgatggatgatagggcccggtccatggatgccatttggaatggtaaaacttatgcccgataacgaagatgcccattggaaagcaggatatgaatataacgttgaaaacataatgggattcagccacattcacgaatggacaatgacaggactcttaatgatgccaactacgggagatttaaaaatacaacctggaacagaaaaacagccagactgtgggtatcgctcccgaattaataagaaaaccgaaacagctcgaatcggttattattctgttaatcttacagattataatatccaagcagaattaacagcaactacccgtagttctcttcagcgatacacattcaacaaaacagagcagccacgaatactagttgactttttctttccagcagaatacgactggaatttagaagatgtatacataaaaaaagtatctgacacagaaatagagggatggaccttgaacgattgtcggtcaacaggataccatggagtacaaagatataaattacattttgtcatgcagtttgataagccattcaaaacaatgaatggctggatacgaaacaaggtatatagccaaatagaacagctacataaatcaaacatgaagtctcgacaggaatttacagtcgaaaataacagtcaagacaaactggacgcaggaatcttcctcgactttaaccttaacactggtgatgatgttatggtaaggacaggtatttcattagtaagcattgataacgcacggctaaatctggaagaagaaatagcgagaccattcggatggaattttgataaagttgtcaccaatcaacaagatacctgggaaacacttttccaaagagtcagtatcacaacagacaattacctgttaaagcaaaaattctacaccaatctttaccgttctatcagtccacggaccatctggaatgatgtaaatggggaatggatagatatgaacggtaacaaagctcttatagacaagccaggtaaaagcgtatatggaggtgattctgcttggggaatgcattggacattaggtccattttataatcttctctatccggagtacatgtccaattggatttacacttacgagcagttctatcgtcgtggtggctggctccccaatggtaatcccggtatgaaatatttcagagtcatgataggcaatcctgctttgccattgatagtctccggctatcaacatggaattcgtgacttcgacagacaacttatgtatcaggcattaattcaccaacaaacagccactatgataaactatcccggaggaggccaagtcggtaacgagagttatcccgattatataaccaaaggctacgtacctctatacgatgacgcatgggattggaattctccgcattatcaatcatacgtttccaatacaatggaatacgcatatcaagactattgcgctgctcaatattttgactctcttaataaaaaagatgacttcaatacatttatgaaacgttccgataactggaaaaacatattcgacccatcaaccggatatgtacgccctcgacgtcccaacggagaatggatcgaaaacaccaacccatatcatgctcccggattttgcgaaggcagcgcttggcaattcacctggtacgttcctcatgatgtaaaaggcctcatcaatctaataggagagcgtcaattcatcgaccggctgaatgccggatttgcaacatccgaaaaagtaagcttcaatgctttaggagataatatgggagcttatcctattaatcatgggaatgaaacaaatatgcaggcagcttacctcttctcttataccagtgagccgtggcacgcccagaaatgggcacgtgctatacaagaaaaatattatggaatgggtccccgagacgcctatccaggagacgaagatcaaggccaaatgagttcttggtacatcttaagcagcataggacttttccagatggatggcggttgcagcaaagatcctgtatggttactggggagtccgcgattcgaccgggtagaaattcagttagacaatacctattactctggaaaaaaacttatcataaaagcagaaaatgtatccaaagacaattgttacattcaatctgtaagattcaataacaagcaccttagtaataactatatagaatggagtaaactcaaaaaaggaggaacacttcatttcattatgagtgaccgacccaatccaaatgcattcaaataaataaacacatatgaaaaataaaagtaaaatactaccagttctttttggtttctttattatggggttctgtgacttagtaggagtatcagtcacctatgcgaaagattatttcagttggagtgaaacccaagccggtttcctgccatcaatggtatttgtatggtttttactcatctctatcccgatttctatctggatggacaagaaaggtagaaaaacaatatcactgataggacttttatctacttttattggaatgttacttccattacttacattcacacagacagcctgttatatcgcctttgcacttttaggcataggaaataccatccttcaagtgtcacttaatcctttattaaccaatgttatcgctgaaggaaaattatcaagcattatgacagccggacaattcatcaaagcactatcttcttttgtaggacctatagtggccggattctgctctgtttatttcaacaactggatattaatgtttcccatattcgccgctattactctaatttccggaatctggttatttttcactccaataaatgagaaagatgacaaaagattaacatccagtttctatcaggttatttctctcctgaaaaataaaacaatctgccttttattcggaggcatcatttgtattgttggcttagatgtaggaatgaatgtatttactccaaaacttttaattgaaaatgcagagttgactaaagagattgcaagttatggtacaagctggtattttgccgctcgcactttggggaccttatgtggtgtaattctattagcaaagttttccgaaatttattattatcggatcaatatgttcattgtattaatagctttatcctgcatttattggatacattctcaatacattattttgttactagtatgcattatagcctttgcaatgtctagcatatttgccgtcatctactcgctagccttgcatacattaccctataaaaccaacgaaatatcaggactaatgataactggaatatccggtggctccatcattcctcctctcatgggagtatgcgcagattataccggaagccaatcaggctccatccttgtcatgctaatttgtgtgatctatctaattttatgttcgtttcataaatttaaaaccatacacacaaaaccctattaacatttattatcaagataaccgtttatatacaaatttatattaaataaataaatctttctagttttcctgctttaaatatatatatttgcaatatgtatatacatataaacattatataatacatataccataatcaattaatactatgtagattaaaatatacagcctttatacacaagaaatcacattaaatctaatataaaacccttatgacttactttttaaaatcacagagtatgaagaagcttttatgcaacttgccacgcttcgtattatggatagctttccttttaatcattgaaagctatgtaaccatgcaagctcaaaccagtagtagtaacaattcatccaaagcaatatcagggaaaattgtggatgaaacagatttgcctattgcaggagctactgtacaggtgaaaggatcaacaaaaggagccatttcggatatagatggcttatttactatttcatccgaaccaggctccattttgattttctcatttttaggataccaatctattgaatacaagatagataaagtacctcaaaccattaaacttttgccaaaggtagatgaattggatgaagttactgtggttggttttgctaaacagaaaaaagaaagtgtgattggagcaatatcaaccttaaaacctgaaagattaaaaattccaaccagtaatctgactcaagccttaggtggtaatgttgccggaataatatctcatcagttgtctggtgaaccaggaaatgacaatgtggaattctttattcgcggagtcaccacttttggttattctaaaagtccgttgatattaattgataatatcgaatcgtccactaccgatcttgccagattgtccgcagatgacattgccgctttctctataatgaaagatgcaacagcaactgccatttatggtgcacgtggagctaatggagtcattttgattactaccaagcaaggcaaacccggtaaggtaaaaattagtgccagagtggaaggttcattgtcagcacctacaaaaagaatagacatggtagatcctatcagctatatgaaataccacaatgaagctgtactcacacgtaatccgttagctgtccggcctcataccgatgagaaaatagcatcaacaaaagccggcaaaaatccctatgtatatccggcggtagactggtacaatgaattatttaatgataatgtatttaattcacgtgccaacatcaatatgagcggaggtagtgaaactgccagatattatgtttctttaggcatatcggatgacaatggtatcatgaaggtagataaacgaaacaattataacagtaacattgatttaaagaaaatctacgtacgttccaacattgatattgatgtgaccaagacgactacattttctgtaaaattcagtggtaattttgatgattatactggtcctattgtaagcggcaatgatttataccggagggcaatggcaacgagtcctgttttattccccaaatattatatgcctgatgaaaatcatgcgtctacttcacatattttatttggtaacgcaggagacggcaattacatcaatccttatgcagagatgatacgtggttacaaacaatacaccaagtcggttatttctgcccaagcagaattaaatcagaaattagattttataactccggggcttagcatcaaagtcttcgcaagtactacccgagagtcatacagcggacaacaacgctctacttcacccttttattattcaatcagttattatgacaaactaaccgacacatatactttaagagaactgaatcctaacggtggacgggaagatttggattataaagcagaagggaatcaggtcagcagttcctattattatgaagcatctctcaactacaaccgtacgttccgggaaaagcataatgtcaccggattattagtaggagttctgagagagaataagagcggaggtgcaagttcgatacagacatctttaccagcccgtaatattggattatcaggtcgttttacatacgcatacgacggacgatattttgtagaagctaacttcggttacaatggttccgagagatttgccaagaatgaaagattcggatttttcccttcaataggagcaggttggatgatctccgaagaaaagttctggaatcaagatctcaaaaatatcatcaataaactaaaactaaaagggacttacggtttggtaggtaacgacaatattggtaaatgggaagacagattcttttatatgtcggaagtaaatctgaacggtagcggtgctaattttaattggggacaagattttgaacggaatgtcggtactatcaatatgatacgttaccgaaatgaaaaaataaaatgggaaattgctcaaaaaatgaatttgggcctcgaagtagggctgtttaatatctttgacatacagttcgattacttcactgaataccggaaaaacatctttggcgaacgccaaactatcccgtatgaaatgggattcagtgcacctctttttgctaataaaggagaagcttcttcacatggattcgaagtacaagtagatgccaaccacgcatttaacaaaaacttctggctgggagtacgtggcaatttcacttatgcaacaggtaaatacgagtatgtagaagagccataccgtccttatccttggctcagccacattggaaaacgtatcgaacaatcttatggactggtagcggaaagactgtttattgatgaagaagatattgcaaattcacctgttcagacatacggagaatatatgcctggtgacataaaatataaggacataaataatgatggaataattaatgacgaagatatagttccaattggatttgccaaatctccagaaattgtatacggcttcggagtgtcgatgggatacaagaattttgatatttcttgtttctttcaaggagcagccagatcttctttctttattaactccaaagcaacgaatcctttcatgcaaatggatctcggaggaaacaacctcaatggtatgatgcaagcatatgcggatgattactggtctgaatcgaatcgtaatatatacgctactttcccaagattgtcaactactgacattgctaacaataacagaaacagtacatggtggttacgcgacggttcttacttgcgtttaaaatcagtcgaaatcggatatacattacctaaaaggctgaccagccatctaggtatgtccaatttgagaatctatgccagcggactaaatcttttcgcatggaatcgttttaaattatgggatgtagaacaaggaaacgacggaatgcaatatcctattcaggcagtttacaattttggtattaacttaagcttctgattacattatgaaatacaaacatttattcactagtacattattggcgatattaatcacatcctgcaactatcttgatatcgtgccggataatatcgcaacgcttgaaatggcattcaacactcgggctaatgctgaaaaatatttagccacctgctataacttcgtacctgcagcagccaatcttgatcacaactccggcctcatctgcggtggagaaatgtggtatctgaaaccagagtcccactactataaaaatataacctcattcaacattgcacgtggtatgcaaaactctaacgaccccttactaaattactgggatggaggtcagggaggctacaacatattcagaggaatccatgaatgcaatatttttatagacaacatcgatcgcgtacctgacatgcgtatggaagagaaaaataaatggaaagccgaagtgatgactctgaaagcatattatatttattatctcatgttgcactatgggcccattcctttacttaaagagaacatcagcgtagaagcagacttagatatgatgcaactggagagagaaacgattaatgatatcgtcacttatacaactgatttattggatgaagccatgaacatcccttccggattaacattcaatgtgacttctccacgcacggaattagggcgtatcacattacctattgcgaaagcaatcaaggctaaattactaatactggctgccagtcctttattcaacggcaatacaatgtatgctgaatttgtcaattcagaagggatacctttcttcgaccaagagtataaaaaggaaaaatgggaggcggcagccgcagcgtgcctggatgccatcaacactgcccacgaagccggagcttctttatacaaatttgatgagaagctaaattatactccttcatcaactttacaacaagagttgacactacgcaacacaattaccagtcgttttaattctgaaataatatgggcattaggttccaatgcaacagatggaatacagaatctatgccaagcgcatttaaccagctattcattggggaacagaatgattcgtagttgctcacaacttgtgccgtcattagaaattgtagaacaattctatacaacgaacggagtcccgatggatgaggataaagattatgaatatgaaaacagatataaactgacaacaactccagaagataatcctattcattttacaccaaactacacaactatcaagatgcatttaaacagagagcctcgtttttatgcctatattggttttgatggtggaaaatggttctccatcgaatgctgtaacgacaatgaaacgagctcctatcctatcaaatcaaagaaaggagatattgccggcgtttcagacgaactatattcaccgacaggttatttcacaaagaaattggttagttatcaaaacgtaaacaccagtgcgaccaatatcaattatgtatattctttcccgattattcgcctgtccgatctatacctgctatatgcagaagctctcaacgagcttaatgaaactccaactacagatgtatactactatgtacaacaggtcaggaataaagccggtctggatgaaggaggttctttggtaaatacatggcgtaatcattccaatcgcccggataagccaaccacccaaagaggaatgcgtgaaattatacagaaagagcgaatgatagagcttgcattcgaaggccatcgttaccatgatgtacgcagatggaagttaggctctacatatctgaatactcagataaaaggctggtcggtattagagcaggacccggagtacttttataatgcacgagttctcttcacgagaaaattcatgccaagagattatttatggcctattaagaccaattctatcaacagaaatccgaaacttgttcagaatcctcaatggtaacttttaacataaaaatgacaaagatgaaaaatatagcttttatacttttaatacttgcagcagtttgttttgcaaactgcgccggtgattacgaggccgaaccacgcggtacgaatgatggaaaagctccggcaccgattactaatatatcggtgaagaatgtaaacggaggagctattattaaatatactccttccgatgatgtcgatttattatacgtcaaagctatcttcactaatacccgcggagagcagcaggaagtaagatcttccatgtatgtagattctttggtaatagaagggctgggggatacacaaaagagagaggtcaaactttactctgtagaccgccacgaaaactattccacaccggctatcgtgactattgagcctctgactcctgcagtcgttcagacacaagaatcattaaaagtgactgaaagttttggaggtttcttcctcgatttcaataatgcagcaagaagtgcattatctttctacatttacaaatgggtagatgagcacaatgaatacgagatccatgacgtatactcctcacaacaggaagaaggccgcctgactataaaaggcttagaacataaattattgaaattagccatcttcgttagggataaatgggaaaacacttccgacacattgtatgccgaaattactccttggaaagaaagcttattagataaaacaaaattccaacttgttaaagttatggatgatgtcagctgggattaccacgaaggctatcattcccgtctatgggacggacaaataggtggatggaactggggacataccgaatacccgatacctttcccgcatgccttcagtattgatttgaatgtcaatgtacgtctcagccaattccaattctggcaacgtctggacagccaagacttattatatgcccatggagctcccaagtacttcaaattatatggctgcgaagagggtaaagatttgcagaatccggataactgggtggtattatttgatggagaaatgaagaaaccatccggcggggcatttggtgatgcgcttactcaggaagatattgaggaagcccaaagaggccatgtatttacccttaaccaggatgtaccattcattcgctacttccggtttcagagtttgatgtcatggtcgggaatggaaacgtcagttatgtcagaaatcactctttggggagatatccaaggcgaagaataaccttataaaatagacagaaatgaaaaaagtaatatatataataactactattctcctgtgtatgacctcctgcacagatattcatgatacctattctgaatatatcaaagacggagaacaaatttatgtaggaaagctggcggatgtaaatatacagccgggatttcagcgcatgatgataaaggggtctatgaaatatctggccacagcaaagacttgcataatagaacttgtaggttacgacaaggttttcacaacagacattgacagaacgcaacctgaattcagttacgaaatcaaagatgtggaagaaggcaactattacgttaaaataaccacaaaggataaagaaggtaatacctcactatccgaaacctacaatgtagatgtatacggaacggagcacatagcgacttattatcccaagcgaattaccgatatacaattcgtcattgccgacaactcgctcaacttaatttggaatcaggcagacaatgtggtggaagcaatagttaagtactatgattcaaatgagcaactactaactttaacagtgaaaggagatgctgcttcaaccaatttacctgattggaaagctacttctatattaacagtagaaacacgaatcctacccagtgaaactgcattggatatcgtatccctgcccatttcagaatacactttgcccgacgatccgattgtagaaatccccagaactaactttgccaacgcaaatatgccttcagatgttgtaaacggttatggcggttcagtagaaaagttatggaacaatgatacatggaattatgacagcggttatcatgccggcgataatcaaggagttcctcatcatctgaccattgacatgggacttacagcaacgattaccgaatgcgaactgttctttaccggatatgaaagaacagactggatgcctcgattattccaaatatggggaattgaagatgtagaagacctggaaagccatgaaccggatgttccatctataaacccggcttgggaagaaagtgcgaaagcaaaaggatggaaacagctgactacaaaaaacatttctatttccggttggcaacccagtattaagttcgcctgcgataaagaacacgaaaatataagatacatcagataccgtattgtagaatcactctcagctccacacgtaggaatgggggcctatggttccgccagcgaaatcaagttctggggtaaaaaggttagtttgttacagtgataacagttgaatttgtttttgcataggagtgtatacaaaaaaagaatgatacattcctatgtaaaaaacaaatttgtatcttgaatccaaaagaccgaaagttaatatgaaaagaataccattgagtttattcacgtttttattcctcctatccggattgtatgcagcacctaccaagactgtctggcaaatcggggagaaaaatcatagtgccagtgagttggcattgtcccctgacaaatacaaagagtttctggcaaacgattttggttgggaggacaggttttatatcattggattgtcttcccctcaaaaagattttccttatgttctgccgggacctgccgatcattggggaggaacaagttatactgccggtatacggactcatgttttaaacatactctttggtatgaaggaagtccccgaaacggactcatggaaattaatcatagacctattagatactcaccacgaatttccggcactatttaaaataacgatcaacggaaaatcatggaaatatgcccttcccaaaggaagtggaaaatcaatagacggtgactattcacaaatcaaaccgcatacgatcgaaattcctctgaactccggagtgatcagaaaaggaagcaactccatcgcgcttacaagtctcgaaggctcatggattcttttcgatgatatcagacttatggggccggataatgctgaactaaatgaagtcaacaaatccgtttatctccgggatgttaaagctgcggactttcaaaccaccagtcctgtagcccaaccactattagtagacatagaacatctttccgggcatcctctccttgaagtaaaagtagatggaaaaaagatactggaacaacgtttggaaaaaggaagatacatactagaagctccgatgccagttgtcaagtctcccaagacaagccactacatcatatccgccgatggtgcaatcttagataaaggaatgatcaggcgcgcacctcacaatacaatcacactggccgattacatcgatacacgaatgggaactgcgcactcccgttggatgatagcaccaggtccgtggatgccattcagcatggtcaaattaagtccggataatcaggatagcggttggcaatcgggatatgatccttcattcgagagcataggtacgtttagccacatacacgaatggaccatggcgggtctgggcatcatgcctgccaacggtcctttaaaaacggagataggcagccagtcttccttagtcaaagatgccaattcgtatcgttcagccatcgacaaaacaagtgaagaaacgaaagtcggatattataaagtagacttgaccgattatcaaatcaaggcggaactgactgccacctcccggtgtggttttcagcgttatacatatccgcaagataaggatgcccgtgtcatgatcgacctgaaaatccctagtgaatacgattaccagcttgttgaaggaagtgtaaagcaaacaggagcacgacggatcgaaggatttagtaagcagctatccaaaaacgtatggtcggcggatgcggatcagaactatacaatctatttcgtgattgagttcaataaagatatcaagaaatttggaggatggcacgatcatactttatgggaaacagacactatgacagcccactaccctcaacgattcggctgttatgccgaatttgatactaccgatcatccggaagttatggtacgttccggaatatcttacgtagatatggcaggggcttccaacaatctttccaatgagataacggaaccattcgggtggaattttgaagctgtacgcaaacatcagtcggatagttggaataatattttaaacagagttcggatatacagcaacgattatcgggaaaaagtaagattctacaccaatttataccgtgcgttctgccggaatactttcagtgatgcagaccgcagatgggtggatgcagcaggcaacattcaaaagctggacgacccggatgctatcgctttgggatgcgatgccttctggaatactttttggaatctgaatcaagtatggaatctgattgctcccgagtggtcatccagatgggtaaaatcgcagttggctatgtatgacgccaatggatggctggcaaaaggtcccagcggaatgaaatacatacctgtcatggtgggcgaacatgagattccccttttagtaagtacttaccaaatgggaatacggaattacgatgcggaaaaaatgttccgggcaatcgtaaagatgcaaactactccagcccaacgtgtagccaatggttttgccggcaacagagatctggaaacttatctgcaacatcaatatgtacctgccgacaaaggacgtttttctaacacattagaatactcttatgacgactggacagtctctcaactagcaaaagcactgggaaaagaggaatattaccgaacattctccgacagaggcaactggtggaaaaacgcaatcaacccggcgacaggttatgcccaaatgcgctacagcaatggagaatgggaaaagaactttgatccgttcaaatcaggagctaaccatcattatgtagagggaaacgcctggcaacttactttttttgtacctcaggacgttcccgcactcaccgaaattatcggtaaaaagcgcttcatcgaccggctgtcgtgggggttcaaagccagtgaaccatggaggtataatgccccgggagaccagtattgggactttccagtagtacaaggtaaccagcaatccatgcatttcgcctttctattcaactgggcaggccaaccgtggcaaacgcaacagtggagccgttccattatcgaccgctattacggctttgacacatcaaatgcttatttgggagacgaagaccaaggacaaatgagcgcttggttcgtcatggctgcattgggattattccagacggacggagggtgtaacgcagaacctgtttatgaactgggaagtcctctgtttgaaaaaataaaaatagatttgggaaaacatttcggtagaggaaagcaatttatcatcaaagctagcaatacttcgcgggaaaataagtacatccagtccgccaaactaaacggcaagaagttgaattctttcaagtttccggcaaaagaactgctcaaaggcggcacattggaacttgaaatgggagatcgtccaaataaaaattggggaatcaaataacatcataaaaaaaatagtaacaaatgaaaaagatcttactcagtcttatcacagcagccattttattatcatgtcagtcatcacatgacacatcacacaagtatacagccatcactccgggagtagaatggctcgacaccaacaacgagaaaataaatgctcacggaggcggtatattatatcacgagggaatctactactggtatggcgaatgtaaaagtgattccacttactggaatcccaatgttcctggttgggaatgttatcgtacggaagccggtggagtaaattgttactcttccaaggaccttctcaactggaaatatgaaggactcgttctccaaccggagatgtccgatacacaatccgatctccatccttccaaagtgctggagagacctaaagttatatacaatgataaaaccaagaaatttgtaatgtggctgcacgtggacagtgacgactacaataaagccgctgccggagtcgctgtttccgattcaccgaccggtgttttcacctatctgggttctatgcacccgaacggtcaaatcagccgggacatgaccctcttcaaagatgacgacggcaaagcctatcatatctactcttccgaacagaattctacattatatatcagtttactgtccgacgactacctgaaaccttccggcactttcacacgcaatttcgcaggtaaattccgggaagcaccagctgtgttcaaacacaacggactatactacgtcatcagttcgggatgtaccggttggagtcccaatgaagcggaatatgcagtagctacccaaattttaggaccgtggaccgtaaaaggaaatccttgtgtaggaaaagatgcagacaaaaccttctatggacaaagtacccatgtactgccggttcaaggaaagaaagacgcatacatagccatgtttgacaaatggaataaaacagacctaattcactccacctatatctggttgcctatacagttccgtgaagacggaagcatggctattcaatggctggacagctggtcacctgatacatacgaattttaattaagatatagcaacagcatatcattttctaaaaggaactcacatgagaaagataaaaattaaagaaatcgtttgtatcatcggattgttgggaactctcacagctcattctcaaaatacagtctggcaaataggaaacaaagataactccgccaaagagttcaagttttataaaaacgattatcggaactacatcaatgatgtttatctatacgaagtagggaaaaatcattctgctgattttccttactttctgccggggcctagcgatgcctgggcaggtggcatatcagggcaggttgttattggcttttcattggccgaagctccttctccgacaacccaaatacaactacaacttctatttgcagaaactcatccttcctcacctccccgactggaggtgaggctcaacagcttcgagaaatccatccaaacacccgaaggcacaaaccctgaatatctggacacaaaagaaacaacttcaaaagagttatccgtcacgcttgacattccggctgatgagttcagagcaggaaacaacacactcacgatccgaaatatatcaggcagttgggtagcattcgaccagataaagctgacatctgcctctcctctgcaaacaaacaatcttacgaccaaagccagtctcgtatcttccgccttctctcctgtattggtgatcggaaagaaaaaagagctgagacagccggtcaaaataaaagcagtcaactggcattataaaaagagaccggtggaactgcaagtcggtaatttcccaccggaaagatacgtattgacccccggaataaataacattgagacatccattccggaagtcaccgctccatgtgagttaccgatcatactgaaagaacaaggaaaaaccgtcagcaaaatcaatgaaaaggcaactcctgtcaagaaatggacggtatatctcgttcagcatactcacacagatataggctacaccaaacctcaaaccgaaatcctgtcggaacatctccggtatatagattatgccattgaatactgcgaacaaacaaaagactacacagatgatgcgaagttcagatggacctgcgaatcggcatgggctgtagacgagtatttgaaaaacagaccggaagaacaagtgaacaaactaaaaaaatacattgccgaaggacaaatagaagttgcttccatgtatttcaatatgtcggagattgtagacgaaaactctttcaagactttccttcagcctgtcaaagaattcagaaaacatggaattccctctgcgctggccatgcagaatgacgtcaacggaattgcatggtgtctggcagattatctgccggacctcgggataaaatacctgtggatgggagaacaccattacaaatcgcaggttccgtttaatatgccgactgtcttccaatgggaatctccgtcgggtaaaccgatcctgacttaccgtgccgatcattataataccggcaatttctggggaatagagcagggagatattcaaaagacagaaccgaagttattacattatttatcagaactggagcgtaagcattatccgtttgatgcagtaggcgtacaatactccggttatttcacggataattcaccgccctccatcattgaatgcaaactcatcagagaatggaatgaaaagtacgcatatcctaagctacgaagtgccactgcatccgaatttatggattatgtaacggagcgatacggggataaaattcccgcatacagagccgcatatccagactggtggacagacggtttcggttctgccgcaagagaaacagcagcttcacgcaaaactcattcggatatgacagcggtagaagggctactgtctatggctgtattaaaagacaaatgcctgccacaggccactcatcaacaaatagagcacatacatgaaagcctgctattctatgatgaacacacgttcggagcatccgaaagcgtcagtgatccgttgtgcgaaaacagtcaggtgcaatggggagaaaagtcagcctatgcatgggaagcagtcaaaagaacacaaatgctgtatgaaacctccgtcggtttacttcaaggagacctccgcagaggcaagaacccgacccttacgattttcaatacgttgaactggaaacgttcggagatgctgactgtatatattgattttgaagtgatcccccgaaaccaattcttcgaaataacagactttcaaggacattcgttgaaagttcaaccgatccgttatcgcagagaagggtgctactatgcaattttcgcagaggatattccgcctatgggatacaagacgtttgaaattgtcttcaaacaaccgtctactgatacaggaactattacaataaacaatgccagtatcgaaaatcatttctacaaactacaactcaacccggacaaaggaacgatccaaagtttgtatgataaagaattgaattgtgaactggtcgatagttcgtctccatgggaactgggtgcttttatctatgagaaattaggtaatcgtgaccaattggcccaatatcgcctggatgattacaacagaacaggattgagtgagtgccggatcatcgacagttcgaatggacctatttatcaacgtatcctgttgcagggaaaatctccgggaacagacgaagcattcggggtcaatctggaaattaaattatatcatgataccaaacgaatagaactggagtacgcaatcaagcgtctgccggaaacggatccctcagggatatacgttgcttttcccttccaactgcccgaaggaaaactggcattcgacgttcagggcggaacagttatatctggcaagaatcaactggaagggacatctacagactggaatactgttcaaaactttgtatcggtacaaaataatcaggcgcaaattattataggaagcagcctcatccccctctatcaactaggagacataaatctcggtaaatttcaatatcagaaacaatacgaaaggcctcatgtctactcgtgggtgatgaataattactggaataccaacttcaaagcttcccaagaaggagagttccgttggagttaccatctgacctcttccgttgacccatctaacaaccttgctaccaagtttggctggagctcacgtattcctctatatgcccgggtaatgccgacaggaacagagaatcataaacccacagagtactcagccttccattttgagaaagacaatttcctgatgacttcatgtaccccctctaaagaagaaggttatatactactgaacattagagagatagatggaaagagaaccaacctcaggattttaaatgaagacgggcaaaccatccccttcacaatagtaaacgctattgaagagaaattggaaaatgaaacgtcagagcatatatttgaggggtaccagaataaatttataaagataaaacgtttttaatcaaaagaatcaaatgcgtagtctaccctaaaaaacggaagaatcatcaccacaaagagacgaggagatgtcaaaagtcagtagcaactctcctaatactattgacttttgcccctcatcatctgtcagaacgaccggaaagtatctgctccaaactttcatcgaccactcccgccaactgaagattggacagcaagcggtcataagaaatcctccctactccttccattttcagcagccatctccatccctttcccgatactaattccagcagttgccctaccgtccggatttcttctttatacaagacattagtcagcctcgtatcggccactttgccgacagacaattggagtaccctttcttcctgattcaaatttatattcttgcttttatccgccaaagactgaaaacgggcatctatgatatgtttccgataagtagccaacacattctttctcactttcagtcctctgagatgagaattataaatctgtaacgccctgtcataagtaattcgatgccgaccggcaactttctctattgactcccccatagagatggagtagaaaatatcacgggctccgggatgaacaatcaattgggaaagttcacgaataataatttcatatagaggtttacacgttttctgtgttcgcaatacatatagcagatcatcatatctggaaataataaagtcgcgttccagctttttctcttccacaatctttgccagataatccgcttgcaatccaagccttttgtgagcttcgagataggcagtcagactttcgtcatccaagaacagttggttgcccatccggcaactggtaatgtaaccgagattcgcccagtttcgcagagttgcttcctgaacgccatgtctttcagacatttgttttgttgtgagccaataggacataaaaaaacggaactaagttaatactcttacctagttccgtaccttttatattataaaagagtacggagctgtcacatcccgctaataggaggtagtaacggctacctgatgtatacgggcagacagcccgtaccctatgagaagtcatagaagtacaggcgtcttcccggcatacatcaaaaaaatccgttacaatttcctattagccgaggaaacgcgcaatcgcacacctttaaacggtatgctacgttccgatgacaaagttacaaatagttttcggaaaataacaaaagaggctaataaatgtttggggaaaattagaaacaaagcaatcgtcactattatataaattcaaaagactatgttgtaacaattaacattaccaatccatcattttatattatataaaagtagaacagaatctgaattatttcacaatatcattcagatcaaagtagagcaaacgtgtagcagaatccacatcttcatcattcaatgggacaaaaccgtttttcatataaaaaggcacagcagccgcatacgcatcaacagttaaaaaacggcaacctgttttattctcaataataaaataacttttaataaaattcaataggaatgagcctattgattgaccttttacagacaagtcaacacccaaacgacaaatctttgcagcaggatagctttttaaacgcttctcattcacaaaccgatgtttgcggaaacgattgaattcagttttattttcaaaatcagacaaagagatcctgtcattggcaagactgaaataagcaaccgatcgctgattaactttattctcaagtacataactgacagccagcaaagcttcccgatacaggaaagattcattcaaaataaaatcgttcaagtcggtatctccgcaatcgaacgattctattttttctgaggtatctagtttacgcatctcatacgttgtctctattaactgacgatccatatctattttttaaatattttcattgccagttcgtagtctttcaatctttttgcccgctgctcggaggtctccctgcgtttttctttcatccgctcttcaaaccgccgtgcatcttctccgaaaagtatcggagtttctttaatcggtcttgccatactcacctatctcctttcttcatttaatacgctacaaaagtaacctaataaatcgggaagtgcaagtaaccaggaatttatcttcgagacatatatgtctcaaatacactcactatatcttctctatatttctttatatcaaaaagagattgccgctatcttcataaaacacggaataaaatacgaaccgaccttcgatatatacatcgagaaatacgattggtagaagcagaattattctcacccctttgagaaaatattctcataggcatgagtattttttctcactgtggtgagaattttttctcaaggcgatgagaatagtttgagaactttattgcagttgccccgccgctttcaagtaagccacatagtttacatacaactgaaaatgggcatccactttcgtctgatacgcctgttgccacataacttgcgcttccagataatccgaaagagtttccaatcccacctcatactgtttgccgctgactttcatattctcttccgcctgttccagcgaacgttctgaaagctcgcattccagtcgggcctcatccaaattattagtggcctgcgtcaattcaagcaacatcttttcattggcattttcctgttcaagacgagtctgttccagttttaccttggcagagcgcaccttattcatacgttcgccaaaatgaaacagaggtactgaaacattcagaaagacggagaatgatccttttttcatcaaagtttcgtcattgatttccaatccatggaaatagtcataacttcccttcactcccacacgtggcagcagttcactccgattcagctttacctgctgctcggccatggcgatctgtttattcaaaataccatattcgggacgggcactgatatcggcaacctgtgtcttccactcttgctccacttccggaaattcatccgagatatcaatccccgctgtcagaggccgaccgatataatggcaaagattcatgccggcaagacggagcgcattatccgccttgcgcaatgccagctcactctcattaagtttcacttgtaccttcaacacatcattctgaggtttcatgccatgctggtgggcactcttcacattccgaaacagctcattgagcaacacatgatatttctccgctactttcttcatttctttggctttcactagttgcacataagccttgtctgtattcagaatcactccggatgcagttagttcctcattcagatgtgccatttccttgccgagcaatgacattttataggcggcgcgaatctttccgcccatataaagcggttgttccacttgtactccgcctgtatagacggtcccgactttatagtccagattcaatccggggaaataagcgtaaccgcttgttgccaactctccagtaacgggatcgggcaggaataccggcagatttcctccccgaatgcccaagctgccgtctgccgtactatacagtccggttccgcttgctgtaaaattggggaagaagttagctttatagctgagagacagcagccgggctgcctccgtctgtttatcggcagcagccatttccttgttatattttagagccatttcacggcattgtttcaggctgagcttctcttgtgccgaaacagaaagagaagccgccattccaaacaaaacactaacagctacgagaaattcttttttcatttgtctgtctttttgatatgaaagaataatgcatacagaatcgggataaagagcaacgtgatgagcgtgccaaacagcaatcctcccatgatagaagctgccaacgaaccgaacatagcatcgggcaacagcggaatcattccaagaatagtggtcagcgaagccatcatcaccggacggagacgactctgggagctatcgatcaacgcagtgaccggttctactccctggctgatctgcaacgtaatttcatccatcagcacaattccgttctttataatcataccgatcaatcccaatgtgccgacaatcgccacaaaattgaatgtcttcccggtcagcaacatcacggcgactacaccgacaaaaaccaacggtatgcagcagaaaatgataatcggcttacgatagtctttaaacagcataatcagtatcgagatcatcagaataatggcaaacgggaagttcttgaacaaatactgcatagatttcgtactggcattcctttcaccctgccattgcagtttataaccgtcgggcaatgggatctgctctatctgtgcggcaatggactggcgtgccttctctgtttctattcccggaacaggcgaacactgtacacgctggctacgctgcccgttatagcgggggacgacgggatcttcccactgtacatcgatccgcttgctgatctgtttcaacggagtagttcccatcaaggtttctaccagttcgtctttcgaaagcgttcccgttttcagtttcatcatcatctcctgcgtcaacaagccattcaaagaaggaagagaagaaaatatttgtgtgttatccaaatcctcaatcggtcttccctgttcgtcaaggcagcgcagatagatattgtcccgatggattccttcgtggaaagaaccgatgggaatgccactggtggccgaaagcaacgagaggcttacatcattacggctcagtccgatagcgcgggcagtcggctggtcatattcaatggtcagcacgggaatctgcggctcccagtccgtagttatcagatatacatccggacagctttccataatgctgcgggcactgtctgccaattgatgcaaaacaaccgggtccggccccgtaaactgtgcctcgatcggatatttcttgaacatcaggttatagcggttcagtttcacgtaggcatcggggtaacgagacgaaagatattgctgaatctcgggcatattatccaccaatgcatcgggagaagtaaagtctataatcaattcaccgtatgccaaagaaggattggctatgttacgcaccaaattataacgaccgggggtaccaccgacggaagctgtgacatgggtcacttccggacgagttttcagataggcttcaatctcttccaagtcacgtgtgacacgggtataatttgttccttccggcaatttatattccatataaagctgatcgtacaccatatccggaaagaaaccctgtttcatgaaccgatagctgaaagctgaaagagcaaccaacgctaccatcgcaaagacaaaactccagcgatgagccagactaaaccgcagcaaggaacgtaggacggcataaatctttccttcatacacccgttttccggtagttgacgcttctttcgaaacttcgggatgcaaaattcggttggccatcaacggtacgtgcaccagagccagtacccagctaagcagtaacgaaaccgccagcacgataaataagtcgcgcgtatacacccctgcagtatcgggagacatgaagataggcaggaaagcaatgatagcaatcaaagtggctccgagcaaaggcatcgcagtctgccgcccgatagcggtcattgcctccatacggctcttgccggctttcagatcgaccagtataccgtcaataataacaatcgcattatcaaccagcatccccatagcaagcacaaatgacgccagcgaaacccgttgcatcgtgccatccacaaaatacaggaacagaaaggagccgaacaccgttaccaccagactgattccgataataactccactcttgaatcccatcgttatcatcagaatgacaactacgataatgaccgattcgatcagattaagaatgaatgttcccaacgaaccggatacacgttccggctggtagaatactttatgacactccactcctgtcggaagccgctccgctttcaattcgtccagtttctgttctacccgtttgccaatcttgatgatatccgaaccggaagaagccgcaatcagtattcccatggcacgctgccggtcataaaagagttcattgcgggtaggattctcataatctttctcaattcgggcgatgtcactcaaacgtaactggtcatcatcgtgcccctgaatcagcatacgtccgatatcttctaccgtcttgaacttgtcactcaccgttacccgaatacgattatcgccattatcgtagtatccggtataagtggttttattctgtccgttcaaggtagcgagaacttcggcaggtttcacgcccagattcgccatccggtcctgcagtaaagagatgttgatgcattcctcacgctttccatacaagtcaacccgttccactccgtccagttcgctgacttcccgctttatcagttcggcataatcagacagttccctgtcctgcaatccgtctcctgtcagcgcataaaacataccgtacacatttccgaaatcatctttcacaaggggagtagcagcgccttcgggaagttccgcctgtgcattcgctaccttacgccgcaacaaatcccagcattgttccacatctgcctccttgacggtcgttttcagttccacctgaatcagggagagatcattgtaagaataactttctacattatctatattccccattgtacggatattcttttcaagtacatccgtcacttccagttccacctgatgtgcggacgctccgggataggtagtcactaccatggcgactttcaccgttacttccgggtcttccaacttactcatttcatagctggaataagctcctccgactatcagcaccgcaatcaagaagtaaattaacttcttattttcaaatgcccatttacttatatcgatcatagcaatcctcccacattggttttagaagcaggcaaaaggggttctacctgttccccgtctttcacatgatgtactcccgaagcaacaatcaagtcaccgggcttcaagccctccgcagtcaccaggcacctgccgctgcccagcagacgggtgactgtcacatcacaacgacggatggtccggctggaagcatcataaaggaaaacactcgccatccccttatcacgaagaaccgcacccgtaggaacggacagatgacgcacttccccttcggtacattctatagtgaccattgtattcattccgggggaaggaagcgcctgcgcttcacctttcttcaactgcaaacgcatcgtatacagttgattggcattcgctttaggggtgacatttatcagatcgagcgcatactcctgaccgggataaatgtcgaacgtacaagtgtaaccggtgaactgttggcgacggatatattctactgccggaagattaatttccacctccggtgtcccctcgctgataatggagacaacgggcataccggccgcaatagtctcatgggaatcaaaaagacgtttctgtacatatccgctgaaaggagcatacaaacgggtatattccagctgatctttcgcatgattgtacttggcggttatctgtttcaacccgtacatcgctttatcattggcgtcgggagtcgttacattctccttataaagtgccatcacacgctccgcctccgccttcacactttgatactccgcttccgcagcatccagctgaatctgataatcagcagggtccagttcggcaagcagctgtcctttgcgcacatacgttccgtcgttgacgtacatacgcaatatagttccgcttacacggaatgataaacttatatcctgcgccgccttcacccgtccgggaaattgcaaagccgtctgtccaccggcagaaagtacagtatcaatcttcactgtaggtttgctatctgtaatctgtgtacgttggctgcaagatgccaacaaaacgactaaaattcctgttaataaaaagttgaatcgtttcatattttcatttgttatttagttcatgcaaaagtatcccaagcagataaaagtaaaaaggttgatttaagctataaattgtccgatttgcagttttttcaacttaaaatcctcaaatactttgctatttgtatttatttatacgtttctttgcaacagaaaccaccccaaaagaaaagaggaaatggaacaacagataccttttagttatgttataatatctccggagaatgctacggaaaaagaaggctatatgatatctaccatagacaagtgtggtttctttttttgccagaaaggagaagtggaagttgccctgaatgacaagtcgtatttaataagtaaaggaagtgtctgcatttatatgacaggcagtctcttgcgcatccagcgtatcagcaaggatataaaagggattatgctggaggtggatttgaattatattattccgatcgttaataagatagtcaattcagaaaacctgctctatctacgggaaaatccctgtttctcaattacagaatatcaatacaactatctggaacaattaatcaaagccctacaacagcgaatggatataaaagcacatgacatcccgctgcaaagacagcacctgatatccgagctcatcaaatcatgggggcaaaccttatgctatgaattgctgaacgtttattttaccaaccagcctctcaaacctttatcgcaagacaaaaaggataaaatctttcagaacttcgtcattaccctcttccgctattatcagcaggaacgggacgttaccttctatgccagtaaacagtacctttcttcccggtacttttctgctgtcattaaagaaaaatccggtagtaccgccctgcaatggattgtacaaatggtaattaccgaagccaaacaactgctcgaaaactccgatctcaccatcaaggaaattgcaacaaagctgaatttcccgactcagtctttcttcggtaagtatttcaagcaatacgtaggtgtctctccgaaagagtatcggaataaacagatcaggcagttgcctttctgaactgacggaactgccaccaaagcatccctcctgcaatcagactggctatcaaatcagagataggcatactgatccacacgccgagctgcccgtaaaaccggggaagaatcaacaggcaaggaatcagtacaagcacctgacgggaaatagagagaaagatagccttgctcgccataccgatactctggaagaagttggaagtcaccatctgaaaaccgacaatcgggaaaaacatcacaacaatccgtaagccctttgccgagatattcaccaattcttcgtgcgtcgtaaagatagaaacagccagttgcggaataaacattcccatcagaaaaccgatggttgtaacaatggtcgcggcataaatcgttattttcagcacttgcgtcacgcgcggatactgtttggcgccgaagttatagccggcaatgggctgcattccctgattcaaacccatcacaatcataacgaagaggaataccagacggttgacaatgccgaaagctccgatagccagatcccctccgtgctgtttcagccccttattaataaggatgacgataaagcaggcggcaagattcatcagaaagggagccataccaatggccagagaatcaaaaacaatcttctttttcagtcggaaaatgcctttatgaaaatgcaggagttcgtccttattactaaacagcttgaactgccagagaagtgcgatgacctgtgcggtaatcgtagcgatagccgcaccctgtattccccagccaaagccgtaaataaaaataggatcgagtatcgtattaatgaccacggtagcaatcgtagcatacatcgccttctgtggatgccctgcggaacgaagtaccgcattcaggcccaggtaaagatgggtgatgacatttccccagaggataaccaccatatagtcgcgggcatagccgacagtcgcctcacttcccccgaagaagtaaagaatcggatcgaggaagatcagggtaagaaccgtaaaagccagtccgatgataatatttaataccagcacattgccaagtacccgttgtgccgtatcataatctttctgtcccagcttcaccgataccagtgtagccgctcccacacctaccagcgaaccgaaagccgctgcaaggttcatcagcggaaacgtaagtgccagccccgaaatagccattgcccccaccccgtgaccgatgaaaatactatctaccatattataaagagaagatgccgtcatggcgataattgccggaatggcgtactgcattaaaagcttcccgatcttttccgtacccagcgcagtgggtgtcttttgtcctgtcatacctattgttttgagggcgcaaagatacaaaaaagagacggattacaggatatatgagaaaagtttcgtatttttgcctccaaaattgagttaatacataacgaaatgaatatattagaactaagtgaacaggaaattattcggcgcaatagtctgaatgagcttcgtgcaatgggtatcgatccgtaccccgctgcagagtatgtaaccaatgctttctctactgatataaaagcagaattcaaagatgaagacgaaccgcgtcaagtttctgtagcgggccgtattatgagccgccgcgtgatgggcaaggcttcgttcatcgaactgcaggactctaaaggtcgtatacaggtatacatcacacgtgatgacatctgtccgggagaagacaaggaattgtacaactctgtattcaaacgcctgctcgacttaggtgacttcgtaggtatcgaaggtttcgtgttccgtacacaaatgggcgaaatcagtatccatgccaagaaactgaccgtacttgccaagtctatcaaaccgctgcctatcgtaaaatataaagacggcgtagcttacgactcttttgaagatcccgaactccgttatcgccaacgttatgtggacctggtagtaaacgaaggcatcaaagagacattcgaaaagcgtgccaccgtagtgagaacactgcgcaacgccctcgacgaagccggatatacggaagtagaaacaccgatcctgcaatccatcgcaggcggagcaagcgcacgtccgttcatcactcaccacaactcactggatatagacctctacctgcgcatcgcaacggaactttatctgaaacgactcatcgtaggtggttttgaaggtgtatacgaaataggaaagaacttccgtaacgagggaatggacagaacccacaaccccgaattcacttgtatggaactttatgtacagtacaaggattacaactggatgatgagcttcaccgaaaagttgctggaacgcatctgtatcgccgtaaacggaagcaccgaaaccgttgtagacggaaagacaatcagctttaaagctccttaccgccgtctgcctatcctcgacgccatcaaagaaaagacaggatatgacctcaacggcaagagcgaagaagaaatccgtcagatctgcaaagaactgaagatggaagaaatcgacgacaccatgggcaaaggcaaactgattgatgaaatcttcggtgaattctgtgaaggcagctacatccagccgactttcatcaccgattatccggtggaaatgtcgcctctgacaaagatgcaccgttccaaacctggactgaccgaacgtttcgagctgatggtaaacggcaaggaactggccaatgcctactcggaattgaacgatccgctggatcaggaagaacgcttcaaagaacagatgcgtcttgccgacaagggtgacgacgaagcaatgattatcgaccaggatttcctgcgtgctttgcaatatggcatgcctcctacatccggcatcggtatcggtatcgaccgtctggtgatgctgatgacaggacagaccaccattcaggaagtactgttcttcccgcaaatgcgtccggagaaagtaatcaagaaagaccctgccgccaaatacatggaactgggtattgcagaagactgggtgccggtcatccagaaagccggctacaacacagtagctgatatgcaggatgttaatccgcaaaagttgcaccaggacatctgcggaatcaataagaaatacaaattagaactgaccaatccaagcgtgaacgacgtgaccgagtggataaataaacttaaataagttgagagttgagagttgagaattgaaagttgttacttgaacaacctttttaatgaccaactctcaactttcaactttcaactttcaactaaatatgaaactacccggtaagatagcgataatgggcggaggaagttgggctacagccatcgcaaagatgtgtctggctcaggaagactctattaattggtacatgcgacgagatgaccgcatcgctgattttaagagacttggacataatcccgcctatctgacaggggtgaaattcgacacgaagcgtatcactttcagttctaacatcaacgatgtcgtgaaggaatcggatacactgattttcgtcaccccctctccttatctgaaagctcatctgaaaaagctgaaaacaaagattaaggataagtttattatcactgctatcaaaggaatcgtacccgatgacaacgtgattgtatcggaatatttcacaaaagaatatggcgtaccacccgaaaacatcgcagtactggcaggtccctgccacgcagaagaagtagcgctggaacgcctctcttatctgaccatcgcctgcccggacaaggacaaagcgcgcatcttcgcccgccgtctgggaagcagcttcatcaagacttccgtcagcgatgacgtagccggcatcgaatatagttcggtgcttaaaaatgtatacgccattgccgccggcatctgcagcggactgaaatacggcgataacttccaggcagtactgatatccaatgcgattcaggaaatgaaccgcttcctgaatacagtacatcccctgaacagaaatgtagatgattctgtttatttaggagacttattggtgacaggatactccaacttcagccgtaaccgcacgttcggttcgatgataggcaagggatattccgttaaaagtgcgcagattgaaatggaaatgatcgcggaaggatactacggcacgaagtgcatcaaagagatcaataagcatcaccacgtcaacatgccgatactggatgccgtatacaatatcttgtatgaacgcatctcacccatgatagagatcaaattgctgactgattcttttagatgagaaaaataggtaataagtaataagtattaggtattaaccgtagccacctaagctttacgtctcatgcataatacttattacttaatacctattacttattacctattacatattacttaaaattgatagatatgattagcttgaacattgaaaaaacatttggattcatctccaaagaaaaggtttctgcttatgaagccgaggtaaaagctgcacaggaaatgctggaaaaaggaacaggagaaggtaacgacttcctgggatggttacacctgccttcgtccatcagcaaagagcatctggctgacctgaacgctactgcaaaagtattaagagacaactgcgaagtagtgatcgtagcaggtatcggtggcagctatctgggcgcacgtgccgtaatcgaagcgctgtctaacagtttcacatggttgcaggacaagaaaactgctcctgtcatgatctatgccggacataacatcagcgaagactatctgtatgaactgaccgaatatctgaaagacaagaaattcggcgttatcaatatctccaaatcgggaacgactaccgaaaccgctcttgctttccgtctgctgaaaaagcaatgtgaagaccaacgcggcaaagaaaccgccaagaaagtcatcgttgccgtgacagacgccaagaaaggtgctgcacgtgtgactgccgacaaagaaggatacaagacatttatcattccggacaacgtaggcggacgtttctctgtgctcactccggttggtttgctgccgatcgcagttgccggattcgacatcgacaaactggttgccggtgctgccgatatggaaaaggcatgcggttctgacgttccgtttgcagaaaaccctgcggctatctacgctgctacccgcaacgaactgtacagacaaggcaagaagattgaaatccttgtcaacttctgcccgaaactgcactacgtaagtgaatggtggaaacagctttacggagaatccgaaggtaaagacaacaagggtattttccccgcatctgttgacttttctaccgacctgcactctatgggacaatggattcaggaaggcgaacgttcgatcttcgaaactgtgatctcactggataaagtagaccataaactggaagttcctttcgatgaagctaatctggacggcctgaacttccttgccggcaaacgggtggacgaagtgaacaaaatggccgaactgggaactcagctggctcacgtagacggcggtgtacccaacatgcgcatcgttcttccggaactgagcgaatacaacatcggcggtctgctgtacttcttcgaaaaagcttgcggcatcagcggctatctgttgggcgtgaatcctttcaaccaaccgggcgtggaagcatacaagaaaaatatgtttgctttgctgaacaaaccgggatatgaagaagaatcaaaggctattcaggctaaactgtaatatccaataactgacaataaaaagaagcggcctctccggagaccgcttctttttattatatttccttcgttacgttaaagtgactcactccctttcaggattcattcattctcaacgacttctgttttcaagtcaatcacttcctgcgctccttcacactccgcttttgaagagagataaaaagataattgtacatcaccatttttatctacatgctcaatagtggcatgaaccagcaccttagtctttgtcacgccatctttgaagcgcaactgccctttttcttcgtctgtcagatttccttcggtagtgacttctgtcttttcataacggagctcagtcttcatctcttccccattctgaagctggaaagatttcagttcggctccattgccgtccaagatcaaaaacgcatccaccttatctcccactttcaaagcaggcatttcactcatccggtttgcatagtcttcgcggatggtttctccatcgccttgatctactttcacatatagcttttctatcgtgataacagggctttctccgctatccgaacaagcacccagaaacaatggcagcagaaacaatactttctttttcatgctattgactagttttatcatgctacaaaaatacatattatcttctaaacgacaaattatcatacgatttatcatccaaaacacaaccagcaactatctcctccattctgttatatctctcattttttatgactatctttgcttcgtatatctctttttatcccaagaataaatgaattctaaataaaagaacaatggaaaaattagtaagaagaccgaatgcagtgatattgtttatcagcttgtcactactgatgatgttaaccaccggttgtcaggaaatcaaactcaaagcaggcatcgaggctgccaacaaacaatgtccgatagacatgggagagaccggaaaaatcaccagcatcgtctatgatggagagaacgtagtgtataccttttatctgaacgaagaggctgccaacatcaagactctacagaaaaatccggaaagcatgaagacttccctgaaaatcatgttccagaatccgaataaagaagtaaagtcattgctggaccttgttgtaaaatgtaaagcgggcctgcaaatgatatatataggtaaagattcgggagagcaggtagtctgcgaactgacaacagatgaaattaaggaaattctcaataaggatgtcgacaccaccgaaagcgacctggctaaactggaaacgcaggtacagatggcaaacttacagttcccgatacaggcaagtgaggacgttctgatcgagaaaatcgaactcagcgatgaagcagtgatttatatctgtcgtgttgacgaagatctgtgtgatatgaaccagattaaagcaaatgccgcagaggtgaaacaaggtattatcgaaacattaggcaatcagaccgatcttgctacccaactgtttatcaaaagttgtgtgaattgtgacagaaatatagtctacagatatatcggcaaacaatcggaagctcagcatgatgtagtgatcaccgtgcctgaactgaaagatatgctgaaaaaagaataaatatcaaacagattccatctaacccaattatgagaaagaaactgaaagccgtcctgttcgatatggacggcgtgctctttaactccatgccctaccactccgaagcatggcatcaagtcatgaaaactcacggccttgatctgagccgggaagaagcatatatgcacgaaggacgcacgggggcatcgactatcaatatcgtatttcaacgtgaattaggaaaagaggccacgcaagaggaaatagaaagtatatatcacgaaaaaagtatcctgttcaattcttatccggaagcagaacgtatgcccggtgcatgggaacttttgcagaaagtaaagagtgaagggctgactcctatggtagtcaccggttcgggacagctttctttgttggaacgtctggaacacaattttccgggaatgtttcataaagagctaatggtgaccgcttttgacgtgaaatatggcaaacctaatccagaaccttatctgatggctcttaagaaaggaggcttgaaagcggatgaagctgttgtgattgaaaacgcacctttgggcgtggaagcaggacataaagccggaattttcacaatcgcggtcaataccggtccgttggacggacaggtgttgctggatgccggagccgatctgctgtttccttctatgcaggcactctgcgatagctgggatacaatcatgttataaacctataaataccgattctactatgcaaaagttattatccttacctcccaacttaattgacagttttcatcaactggaagaagtgaatcatactgactggttttgtacatcagaccctgtaggcagcaagttaggctccggaggaggaacgacctggctgttgcaggcctgccatcaggcttttgcaccggaagagactttcagcaaatggattggaaacgaaaaaaagattttgctgcatgcgggaggacaaagccgccgcttgcccggctatgctccttcgggcaaaatactgactcccataccggttttcagttgggagagaggacaaaagctgggacagaatctgctgtcgctgcaacttccgctatacgaaagaatcatgaagcaggctccgaaaggcttgaacacgctgatagccagcggagacgtatatatccgttcggaaaaaccgctgcaagacatcccggaagtagatgtcgtatgttatggtttatgggtgaatccttcactggctactcaccacggagtattcgtatcggaccgcaagaagccggaagtgctcgacttcatgttgcagaaaccttctttagaggaattggaaggattatcaaagacccatcttttcctgatggatatcggtatatggatattaagtgaccgtgccgttgaggtattgatgaaacggtcattgaaagaaggcacgaatgatatcagctactacgatttatattcggattatggcctggcactgggagagcatccccaaacgacagacgacgaagtaaacaaactttcggtagcaatcctgtctttacccagcggagagttttatcatttcggaacgagtcgggaactgatttcttccacactcgccatacaggataaagtgcgtgaccaaaggcgtatcatgcaccggaaagtaaaaccgaatcctgccatctttatacaaaactcgtttacccaagtgaagttatctgcagagaacgccaatttatggattgagaacagccacgtaggagaaggatggaaattaggttcacgacagattattacaggagttcccgaaaaccattggaatataaacctgccggacggagtctgcatcgacatcgttcctatgggagacgcagcctttgtcgcacggccttatgggctggatgatgttttcaaaggtgatttaagaaatgactcgaccacctacttggggaactctttcacacagtggatgaaggaaagagagattgggctggaagacataaaaggacgtacagatgatctgcaagctgctcctgttttccccgtaacgacttccatcgaagaactgggtattttaatacgctggatgacagctgagccacaactaaaacaaggaaaagagttatggctgagagctgaaaaactatccgctgacgagatatcggcacaagcgaacctggaacgtctttacgcacagcgcagcgctttccgcagggataactggaaaggattgtccgccaattatgagaagagtgtattctatcagcttgacttgcaagacgcagccaatgaatttgtccggctcaatctggaggttcccgctgtcttgaaagaggatgccgcacccatggtgcgtatacataaccgtatgcttcgggcacgtatcctgaagctgcaaggcaatgaaggctgcaaagaagaacaagccgcgttccagctactccgtgacggattactggaagccgttgccggaaaaaagaactatcctaaactcaatgtttattcggatcagatcgtatgggggcgtagtccggtgcgcattgacgttgcaggaggatggacagatacacctccctactctctctattcgggaggaagtgtagtcaatctggcgattgagttgaatgggcagccgccgctacaggtatacgtcaaaccatgtcacgagttccatatcgtacttcgttccattgatatgggagctgtggaggttatccgaagttatgaggaattgcaggattacaagaaagtcggttcgcctttctccataccgaaggcagcacttaccttggcaggattttccccattatttgcggcagaatctcatgcgtcattggaaaagcatctgaaagcgttcggttcaggactggaaatcactttactggccgccattccggcaggttcgggactaggtaccagttctattcttgcatctaccgtactcggagctatcaatgatttttgcggactggcatgggataggaacgacatctgcaactatacactggtattggaacaattgctcaccaccggcggcggatggcaggatcaatacggtggcgtattccccggcgtaaaattgttgcaatccgaatccggctttgaacaacatccgttagtacggtggttacccgaccagctctttgtgcagccggaatatcgggactgccatctgctttattataccggaatcacccgtacagcaaaaggaattttagctgaaattgtcagttccatgttccttaactccggagtgcatctgagtttattggcagaaatgaaagcccatgcaatggatatgagcgaagctatcctgcgaggtaatttcgaaactttcggcaatcttgtcggcaaaagctggatacaaaaccaagcattggacagtggcacgaatccaccggcagtagcagccattatcgaacaaatcaaagattatacgctgggatataaattgcccggtgcaggaggtggcggttacttatatatggtggctaaagatccgcaagcggccggatgcatccgtcggatattgaccgaacaggctcctaatccgcgtgcacgctttgttgaaatgacgctttccgataaaggattgcaggtatcgagaagctaggataaaagtcatataaaaacaataatcccttgataactgctgattatcaagggattttcatgtgaccccggtgcgattcaaacgcacgaccttcagaaccggaatctgacgctctattcactaagctacggggccatttcctaaatgcgatgacaaaagtataaaaaatcttctcatcttcctaatgattcatctttttttatagttcttaagtcagtattgccccttaacattctgttattttgaaatgctttagagcatatactttatcaatttgacaatcttttagagaatatccaatacagatattaatattattcctatctttgccgacaattaacaatcaacaatcctatgagttacttgataaaaccaaagaactataaaccgttactcgacttaaaacaaacagagttgggaatcaaacaaataaaagagttcttccagttaaacttgtcatccgaattacgcctcagacgcgtgacagcccctcttttcgtattgaaagggatgggtatcaatgacgatttgaatggtatagaacgtcccgtttcattccctatcaaggatttaggtgacgcacaagcagaagtcgttcattcattagccaaatggaaaagattaactctcgccgattacaatatcgaaccgggatacggtatctataccgacatgaacgccatccgttctgatgaagaactcggaaacctccattcgctctatgtagaccaatgggactgggaacgtgtcatcaccaacgaggacagaaacgtagaattcctgaaagagatcgtaaatcgtatctacgctgccatgatccgtacagaatacatggtatatgaaatgtatccgcagatcaaaccttgtctgccccagaaattacattttatccattcggaagaactacgccaactctatccgaacctggaacccaaatgccgcgagcatgccatctgccaaaaatacggtgccgtatttatcatcggtatcggttgcaagctaagcgacggcaaaaaacatgacggacgtgcaccggactatgatgactacacatccaccggcctgaacaacctgcccggactgaacggtgaccttttactttgggatgatgtactgcaacgctccatcgaactatcctctatgggtgttcgtgtagacagagaagcgctacaacgccagctcaaagaagaaaacgaagaagagagactgaaactttatttccacaaacgattaatggacgacacacttccactatctatcggtggcggtatcggtcaatcccgtttgtgtatgttctaccttcgcaaagctcatatcggagaaatacaagccagcatctggccggaagatatgcgcaaagaatgtgaggaacttgatatacaccttatataattgctatgaacgtacaaatagaagaaagctggaaaacacacttacagccggaatttgaaaaagattactttcgcacactgacggaattcgtaaaaagtgaatacagccagtatcagattttccctccgggaaaacttattttcaacgccttcaacctctgtcctttcgacaaggtgaaggtagtaatcatcggacaagacccgtaccacggaccgggccaggcacacgggctctgtttctctgtaaacgacggagtacctttccctccttctttggtcaacatctttaaagaaataaaggcagacataggtacagacgctcctactaccggaaacctgactcgctgggctgagcaaggagtattattgctcaacgccactctgactgtacgcgctcatcaggcaggctctcatcagaatcgtggatgggaagcttttacagatgccgctatccgcgcactggcagaagaacgggaacatcttgtatttatcctgtggggagcttatgctcaacgaaaaggagctttcatcgaccgcaacaagcatctggtacttagctctgcccatccctctcccctttctgcctacaatggtttcttcggaaacaaacacttcagccgtgcaaacgattatctgaaagcaaacggagaaacggaaataatatggtaagaagttgagaattgaaaatggaaagttgagagtcggctgcacaataaatgatgacgctgcatagtaactctcaactctccattcatcttattattgctagatattgttatatatctgtctacacttttctattcttaaatatccgcattagcttaccttacacaacactaagtctatttaatcttaaaaaaatatttctcatacataaagctagccaatagatcaatcctataaaacaagattaaatccaaacaccatataatattatcagtatttatttcactactacaaaatatacaatgaactattgttcataaattctatagaattgaaaatcattaatttaagttcagttctttttccataaataattctacctttgctttgtactcatgagacaaaaaattatcaacctttaaaccaaaagtaaaatgaaacgaacaaatttatttttcggtttggcatttgcattattctgctcattgccaatgtatgcacaaacagtatctgaagatgtagatatcaacactacatcagaatctgcaactcccagatttgtcaacatgttcattaatgataatggtgccatttatcccatttacgtacccaatttatctgaaaacacaaagattcaggaagtttggaatgaagcctctgctatcttgggcacaaggtattttgatctttactataatggtcaaaagttgagcttagacaagagtttcgctgattattggatcacaggtaatatttctgtttaccttgaagttagaaggcgttaagttaacaattacttttcttacagagagagtgtgttgtccggagcacactcttttaaacaaatactttttcttagtctatttctctctcttgcctaaataaattatatatactatattgatcaaacacatgcattttcatttcttcatcgccaaaatctgtatttaatagacttttatctatttcgtatctgaattcaaatcacaaaatacaaaattaagtgattatatataaatgataaatatattcttagataaatattcatcattcataaacttaagttcatcaacacctctatatttgcattttttattactaatacatattaaacgcatagcattttccattacatttataacaaaaagcctaccataactcataataaaacgaataatatgcatagtaaaaatgatttcaacattgaaaattacataaaagctctatccacatacataccagcgtcctccatggtcaaactaaaaaaagcatataaagccttcacttttacaaaacaccctaaatcaactattcttgaaaacagacaactgaatgattcattttgcatccttatatgtgggaccataagacattacacaatagatagtaacacagcagaagaacaaacattacgattcaccctctcaggcaatttactgtgtcaatatggaaccgctacagaagcaacagaatatttaagctgcctatctgaatgtaccattttatctgtctcaaatacaattttagcagagataggagaagaaacaaatttgagaatatactgtcaaaatattataaaagaaaacttagagttagaagtggctctattaagaatgccaccagaaaagcgatatataaaactatgcaaacaatatcaaaacatatttctgacggtcccattaaaatacattgcgtcatttttaggaatcactccccaagctttatgcagaattagaaagcgtttactaataacaccctaataccactgaatattactttgcgtctgacttctctgctcatatttcaagtcttgaagaatacttgcattagcacgaatcgtaacattatagtatttccaacgtccaaatggtgaaagactggcagacaagttaaagcagtgcaaatcacgagaaatcgtacaggaagtctgcgttatttccttcgcttggaaatcgtaacccgaattgaacgaaagcgaccagttattggaaatcttcacattaccattcatattgatattgtgagtataagtaaacggatatctcatcgaatagcgattaataggcttagtcctatcttcacgaatattaaatgaataactgaaacttaaagaccaaggcatcttgaatacttgataaccatccgggtcggcttgcgccttctctactttcttggtcgtagttccatcttccgtaccttcagaatcttctccgtctccatcttctgactccttcttgtctttatccttctcgtcttccttcggaccgaaccactttttccaggtatcgttattaaaggtatagttaaaagaagaaccatacccctgaaaacgtccgaaacgtccatacgaccattcagttcgattaccttcgaccacattaccacttttatcaaacgtataagcgtaagtagcaaatgatgcattcatattgaaagtataattctttgtcagtttcagtcgaagattcatactcaaggggctccatggcttttcctttgcagccatattatatgacatattcacactcaaatcatcaatcaagctgactttctttaatgtatccttcttagcatcataatatttcatctccagattattagcaatcgagaaactaaccgttcccgaaccctcacgtgaagggactccaaaaggctgtcccgtatagggtgaataatactgagtatttccgttattatccgtatactcttcccagtatttactaaatgcaggagcaccactgataccaacctgcggagtgacaacgtggcgaatctgtatctctttcttcttcatgaaaagaggtttgtacataccatacagtttagtacttaaagacaaactggctgaatagttggaaacacgataaaagccattaatagtatcattcagattctgttccaaacgccctgtttcctcattatacgtctgatttatcttgcgggtgtaccaacgctccgtataattcaccgaaggattgacctgcaaatacttgaacagtgtaaaagtagcactgacaggaatattatggttcatcgcattttcccatccgctgatgccggtcttgaacagacggtcgtctttagtacggatactgttcgtcagacgtcctgtatagctgacagaaatcttctcataccaacgctcggctccggcagccttcttccgcttgaagggaaacagacggctcaatgtaatattaaggtcaggaagcgttactgcaatggatgagtcacgcatggtctgcgcaatattggtcgttccagacaaggtcagaccgatatcggggaaactacgggagtaactgatacttgatgtctttgtattctgagtcaacaactgggagttataaaggttgttgatgttagatcgttcgtaactactggtagagaagttcacactggcggagaaagtactgttcggacttgccttggcatcctgacggtggttccacactaccttgaagtctttggcaaccgtataatccggcattcctttgtctccggtcttggtcacctgataatccgcctgcaatgtaccggagtatttgtacctcttattataattggtcaatccggaaagccgccatgaacctttcgtgaatatatctcctgtcagcttcaagtccatgatgtcactcatagcaaagtaatatccgccttccgccagaccgaaaccacggcttgaatcatccatatacgtcggcataatgaaacccgaagaatagctgctggagaaagggaagaagaaaaacggcacagccagcggcaggggaacatcttccaccacaagataggcaggtcctgtcactacattcttcttggggcgcactttggctcttgtcaactgcatatagaagtgaggatggtcatgatgatcacaagtcgtgtagcgaccgtgctccataaagatttcatcatttgctcctttcttggctctgctaccggtcacataaccttcaccctgttgagtgataatatcggtgattcccgcttttttactcttgaagttatagctgattgtttctgtatcgtatgcagtttcaccttctttaaagacaggtttacctttgatcgttcccgtcgtgtctttaataccataggcgtgtactgtactactgtccagattcatggaaatcacttccgctgccagctcaatgttctgatagttgactttgccgctaccataaagcgtagcggcacctcccaatgtaaaagtggtggagtcgttagattcataaataaccggtgcatcgagcggttgtttctttgtcggtgctacagagtcaacgcgtaccacaactgtatccgcccctaacgaatctttcctgttaagggaatccgtttgtgcagtgttggaggcaatcatccctcttcttcgacgctgagacgtagcctcatcaggaagcatcagcaagacaatcagcaatatgaatgatataattatttttgctctcaatggcgccattaactaatagttttacgcttgaagtggcaaaagtacacaatcttcatcaataatgcgtgagaatctccgttatttaattattttttagtgctataaaaacaaagagcaccacccatcaaagcggtttagaccttcttcaccatattttgcaatgcttttccgggctttttctactgtcttttcttcgtcaagatgagttttagaaaagaatttatcggcaaaacagattatttgctcttccagagtgacgggcaccatctcacgatgaggaacaggaagctggcgttctatgatttcttccagtgtcagtccggctccggtgtgacgttcgcaaaccagtgcatggcgttcaaaaccttcttttcgtaaaaggtctgcacccagatagccgtgcgcgatgtagggatgctctccgaaacattggatggtgggagcatcggtcataaagattcctatatcgtgcagaagcgcggcttctctgacaaagctgcggttgataggtaagttaggatgtgcatctacaatcttcaaagctttttgggctacagaaaggctatgtattagtagaatgtgtcgttgttccgtatcctgcggataaaatttgtcgatgatttctattggattcatactttttcactagttattacttgttcccttactgataaatgatatttttgtgcaatattacaaaaatttactgatatgcaagccagaagttccctcattcttttctctctgttcataatactgtgttctacatacgccagtggaaaagtaattacgggtgccgagcgtatggatcaatacctgccgttaatcaaaggaaagcgggtaggaatggtggtaaaccacacttccatcgtcggcacagagccaattcatctgctggatactttattaaaacaaaaaatcgatatagtgaaagtctttgcaccggaacacggtttccgcggcaacgcggatgccggtgaaacagtaaaagacggaaaagacagccgtacgggagtaaccatcgtctcgctctacggagataataaaaaaccgactgccgcccaactgaaagatatcgatgtaatcttgttcgacatccaggatgtgggcgcacgtttctatacatatatcagtacgatgtattatgtaatggaagcttgtgcggaaaacaaaaaagagatgattatactggaccgccccaatccatgcgattacgtagagggacctgtattaaaagccggatataaaagttttgtcggaatgctgcctttgccggttcttcacggttgtactatcggagagctggcgcagatgatcaatggagaaggatggatgactacccaggcaaagacttgtccgctgactgtgattcccgtaaaagggtggaaacacggacagccctatgcacttcccgtgaaaccgtctcccaacttgcccaatgcacaatccatccgcctttatgcctcactttgcccttttgaagcaacacgtgtcagtgtgggacgcggaacgacctttccttttcaggtgttaggcacacctaacaaaaagtatggcgattttgccttcactccgcgctccctgccgggattcgacaaaaatccgatgcacaaaggagtcacttgttatggcgaagatttacggaacgtaacagacgtaaacggtttcacgctccgttactttctgcgtttctaccgtttatccggcgaaggcgcagcattcttctcccgtccccgatggtttgacttactgatgggaacggattcggtacgcaaagcgatccttaaaggagaatcggaagaggaaatccgtgacagctggcaaaaggagttgcagacctaccgtgatatgagacagaagtatttactttactaaggaacggttcctccacttctcagcattccgttcgaactcttcggctttctttccactcaaccttgcaggcatttcaagtatctccggaatgtcttttgcattgtcaatgatttgagtgccggaagcgttcttcacaatacggacatcatcgtacagtgagtcattctccagataagcttgcatccggagcgtgtctcccgtcacgtcgatatgctggtagaaacggcggtccgtcccgaaacgatcatacttatcattgaaagatagacggtaactcttcggggaagcgtggcttaccagatacaacggggtggtcatttcgccctcatcgttcttattagtcatacgggcatagttatgctcatgtccctgaagcaccaagtctactccatattcacggaacagtccgtcgaacatccagcgtacggcaaggttgttcgttttaccttttatagaatatacaggatgatggagcatgacgatcttccatttctttttcgaagccttcagcgttttctccagccattcccgttgagagaagaggaaccaaggatcacggttactatccagcgtgatgatagtggcatcgttgtaatcaatagaatatacattattattcttatacctcgattcgagcagataagaaaagacataagcaaatcgtttctccaaaacacgtaccagtccttttacatattcatgatttcccggagaaaccaatatcggtttggtgggagctatggaatccacactctgataggcttcatcccagtaacagttcatcggacgctctgcaaagtcaccggcaaacatatagaagtccgcctgcggatagcgatggcgcacattttccataaagccacgtgtctttccacgcaaagtatcctgcacgtcacctataaatataaaggagaaatgatcagtcgaatcgggttgcatcgtgaacgaataccaatcggatgagcgatcgtcattccatacccgataagagtaggaatcgccataagagagttctttaaattttgcccagttggcataaccgaacccgcccagtgtacggagaaatttggaagagccgtcaacgagaagagtatctccggaaccgatctttgtatattccagctttgcctgcttggaaacgcctccgcacacccagctcacattacgggacagttcgccgtcatttccgaatgtcagaaatacccgttgcgggtcttccgtcagcacatagcgtatttcagggatattgtggaaccagactttccagcgtatcttacaaatgacaccaccggcaatcaatatcaggagaacgatgccccaagctattttcttcttcgtaatcttcatttttccgattttaaaaactggtagcaaagataaatatagtgtcccataaatcggaaattatgtccttttttaacctttaacaaattcacatctacatgagaatttaaatatctaaaattgctgtcatctgtcaccaaaagctaaataacacattgattataagctaataaagaggtgacagcagggcgtaacagcattgtgacagcacattttgttgtcacaatgccgtcacgctttgctgtcatatcctgctactatcatatattgctccttggaatgataaatcgtaagcccccgataaagtacccgttgtctttgtatctttaagtctcgatctttgctagaacaaccgcaacccaaaaaggaagtggtgattgaaccgttgaagcagaatattttctttgccataaactctgcaaagattcaggacgatcagcaagccaagattgcttctctagtagaatatttagagaagaatgctactgctaaagtgagcgtgacaggatatgcagacaaaggaactggtaatgccagaatcaacagcaaattatcggaaaaacgtgcgaataatgtagtggaagctttgaaagcaaaaggtattgctgccgatagaattacagttgcttataaaggtgatactgttcagccatataatactcctgaagaaaatcgggtaagtatctgtattgctgagtaaatatggcacacaaaggctattaagaatttaaaatttccctatttctcatgagagagttttccccacttctttatatatatcatttatataaggtgttctctctgagaatcttaagaggtccgtacttgtgaaagtccgtacttctgcaataataaccctttcttcacttaaatgtgaagattacattggggaatagttggaaaggtggtgcttgcgaaagtactcctttctcttacctatttcctgttggaggatgtctccctttttcccacggacatcctcttttatacaaaaaggcgactcatactgaatgggccgccttttctgttatttaatctcgatttcctccttcatatcgatttcctctccatgtgtatcgtagaacacatattgcaggaaagcgagtttctgacttggaatgatcttgataccgaatccgtatttcatctgccacttccgtctgagggaaacgagtccctgattgatgaaggcggcgacatacggatggacgtgtaacgagaatttctttaccttcagtttgttgaccagataatcaattttactctctaaagtgtccgtaaagagaatggacgatttgatagtaccttttccgaagcaggtagggcagatttcggtcgtgttgacgtccattgccggacgcacgcgttggcgtgtaatctgcatcagcccgaatttgctgagcggcagaatattatgccgtgccctgtctttctgcatgttggcacacattcgttcataaagcttctgacggttttcggcttcattcatatcgatgaagtccacgacgatgataccacccatatctcttaatcgcagttggcgagccagttcgtcggcggctcccagatttacttcgagtgcgttaccttcctgcccgttggcattcttggtgcggttaccgctgttcacgtctactacgtgaagcgcctcagtgtgctcaataatcagataggcaccactcttgtaagagactgttttaccaaacgatgatttaatctgcttggtgataccgaaattgtcgtaaatgggaagctggcctttgtacagtttcacgatgtttgcccggtcgggtgcgatcagtgtcacgtagtctttgatttcattgtacacagcctcgtcgttgacgtgaatattctcaaaagaagggttgaagaggtcgcgcaacaaacctacggcgcggctggtctcttcataaatcaacgtcggatacttggtggctttctgtactttcgccattgcatcttcccaatgcttgatcaggactttaagctctccgtcgagttcggccacgcgtttgccttcggccactgtgcggacaatcacaccgaagtttttcggtttgatgctcatcaacagttgtttcaggcgggcacgttcttcgctcgatttaatcttttgcgaaacggaaaccttatcattaaaagggatcagtaccagatagcgtccggcaaacgaaatttcggacgtcagtcgcggtcccttggtagagataggctccttaacgatttgcaccaccacttcttgtccgacctttaatgtattggccactgtgccatccttgtccaggtcaggaagtagggttgctttactgatggagttcagcttctttttgtcgcttaaagtctgctttacaaacttttcgagtgagttaaattgaggacccaggtcaagataatgaagaaaagcgtctttctcgtaaccgacgtctacaaagcatgcattcagtccgggcatcaatttcttgatacgtcccaaatacatattgcccactgagaaagaaatgtttcttccttcgctttgaagttccaccagactcttgtcttcgagaagggcgatggagacctctttgggctgtacgtctattacaatttcacttgtcactgttttgctttcttattattgattgaatctcatttatatgaacaacttttttgacaaaatgttcatttagggttagctacttaaacaaagaacaaacttgaaagacatgtagcttcgcaagtttgttctttattctgtttgatcagacttaaaaattattttttgcttttatgtctgttctttcttagtctttttttacgcttgtgcgtagacattttatgtctttttttcttttttccgcttggcatagcttcacattttatgggttaatactcttgtttattatttctttactgaaattgtaaatgtcttagccggtttgaaggccggaatgttgtgctctggaatgatgatagtagtattcttagaaatattacgagctgtcttttgagctcttttcttaactacgaagctaccaaacccgcgaaggtatacattctcatcgttagacaatgagtctttaacagcttccataaatgcttcaactgttgtaagaactgttgtcttatcaataccggttttctttgtaatctcgtttacaatatctgctttagtcatttttccttaaaaaaaatattattactaggttcttgctaattttttggactgcaaatatatagctttttggtctcctaaaaaaatatattctgcacatttttctaaaaaagtggaggcattaagttttcttagagacaaaagagttacttttgtactgcttttggatagtatatacgagataaatgttagatgatagatcgaaatcaggaatgaatatttttagtgaggctatagttgaatggtataaagaatacaagcgtgatttgccttggagagaatcgtcggacccgtatcggatctggatatcggagattattctccagcagacacgggtggcgcagggatatgattactttctccggtttatcaaacgttttcctgatgtgaaggcattggcagacgctgacgaggatgaggtgatgaaatactggcagggactgggatattattctcgtgcccgcaacctgcatgctgcggccaaaagtatgaatggagtttttccggaaacataccccgaagtgctggcgctgaaaggagtaggggagtatacggcggcagctatctgttcttttgcctacggtatgccttatgcggtggtagacggaaatgtgtatcgggtactttcccgttatttcggcattgatactccgattgactcgacggaaggaaagaaactgtttgctgctctggcggatgaaatgctggataagaaacagccggctctttataatcagggtattatggacttcggagcgatacagtgtactccacagtcacccgattgtttgttttgcccgttggcggatagttgttcggcactttcaacaggaagggtgactcagcttccggtgaaacaacacaagacaaagacgacgaaccgttactttaattatatctatgtacgtgcgggcgcgcatacctatataaataagcggacggcaaacgatatatggaagaacttgtttgaactgccactgatagaaactccggttgctttgtccgaagaggagtttcttgcattgccggaatttaggtcattaatagcatcgggtgagaatccggtgatacgcttagtctgccggggtgtgaagcacgtgttgtcacatcgggtcatctatgccaacctgtatgaagtggctttgcccgaagacacgaagtccttcgctaactttcagagaatacgattggaggaattggacaagtatgcgatttccaagttggtgcagaccttaattcaggtaataggtaataagtaaaaagtaggtaataagtaataggtattaagtattaaccattcggtttatagcgcagcttattacctattacccattacctattacttattacctactttttacttattacttaaaatacttgcatactattgttattctgtttaattttggcagcagatttaaataatagaatcataaacttgatacatgtatgtcagtaaataaagtgatattgataggaaacgtaggacaagatcctagggtgaaatatttcgatacaggttcggcagtggcaactttccctttggctactactgatcgtggctatacattggccaatggaacccagattcccgaaagaacggaatggcataatattgttgcatccaaccgtttggctgagattgtggacaaatatgtgcacaaaggtgacaaactgtatctggaggggaaaataagaacccgttcatatagtgatcagtcgggcgctatgcgttatatcactgagatttttgtggacaatatggaaatgttgtctccgaaaggggctaatacaggtgcgggagctcctcaaccatctgcaacacaggctcagcagccgcagcagatgcaacagccgcaacagccgcaacaacaggcgcagccgtcacaggcacagccgatacaagataatccggcagatgacttgccgttttagatactgtgataatgtgtcaataggctgatggctgattggcacattatcttttgtttaactaaaatacatactctttggactcagatggttatttaagccaattggctgaaattttcaacggtattaccgtaaacactccttcaatctctgctattatcgccatagtactggcaggtgtgctcctgcttgcttccggctttgcttcggcttctgaaatagcttttttctcactctctccttcggacttgaatgatattgacgaacacaatcatcctgctgacgaaaagatcagcgcactccttggagattccgaacggcttctggctacgatactgatcactaacaattttgtgaatgtgaccattatcatgctctgcaacttcttcttcatgaatgtattcgtgtttcattctcccttggcggagttcattatactgactgtaatcctgactttcctgttattgttgtttggagagatcatgccgaagatttattcagcacaaaagacattggcattttgccgtttctccgctccgggaatctattttctggagaaactgtttcatccggttgcttctatgctggtgcgttctaccacttttctgaataagcactttgccaagaagaatcataatatttctgtggatgaactttctcatgcattggaattgacggacaaagctgaaatttctgaggaaaataatattttggaaggaattatccgcttcggtggtgagactgtgaaagaggtgatgacatctcgtcttgatatggtcgatctggatgtccgtacccctttcaaagaagtgatgcagtgtatcattgaaaatgcttattcacgtatccctatttattccggttcgcgggataatatcaagggtgtgctatatatcaaggaccttctgccacatgtcaataagggagataatttccgttggcaatcattgattcgccctgcttattttgtgccggagacgaagatgattgatgatctgcttcgtgattttcaagcgaataagatacatattgccattgtggtggatgagtttggaggtacttccggactggtgacaatggaggatattatcgaagaaatcgtaggcgagattcatgatgaatatgacgatgaagagcgcacgtatgtagtgctgaacgatcatacatggatatttgaagcaaagacacagttgactgacttctataagattgcgaaagtcgatgaagatgaatttgaaaaggtagtaggtgacgctgatacgctggcgggcatgctgctcgaaataaaaggtgagtttccggcattgcatgagaaggtgacttatcacaattatgagtttgaggtgctggagatggatagccgccgtattctgaaggttaagttcacgattcttccgaaggagatggatgagtcggagagtaaggagtgatgagtagataagacctgttcgggcggagaaactataatcggagaagaaattataaaccaaaaacgatgggattatttctgcaacataaaacggttgatatgcagtggtctgtctggaagatggaggaatctttggatacactgtttagtcttctgcccgatgtccgaagagtttcttgtgagcaggaaatgcagcgttttacttcggaccgaaggaaactggaatggttgtctgtccgtgtgctgctatattccatgttgcaggaagataaagagataggatattcatcggaaggaaagccgcatttgacagacaattcttcttttatcagtatttcgcatacaaaggggtatgtagctgtgatacttagttccgtagctcctgtaggcattgatattgagcaatatggacagcgtgtgaaaagagtatacgatcgttttatccgttccgacgagcgagtagaaccttatcagggagatgagacttggagtatgctgttgcattggtcggcaaaggagacaatcttcaaatcaatggaaaatgctgacgctgatcttcggaaactttgtttatcacatttcattcctcagagcgaaggggtattccaggtgcgggagtatgcaacggaacggcagcaattgttcaccgtcggttatcgtatttgtccggactttgttttgacgtggactgtcactatttgaagcatatttgcatattgataaacggtgaataatgagtggaatggtccaccattattcaccgcttatctttggttacttatctttcttgttcagtctgtaacttaatgctcccgacggacatttactgatttgtgcaattagctcttccgttgtagcattctcgatttgtacccacggcctctctttcgggtggtaaacattgggtaacatttttacgcagattcctgcatgctggcacatttccggctgccatacaatggttagttcgccattggtatattcaactttttttcccatatctatacttatttaatatgaatgccacgcattacaattctcttccattccggatgtttatgaatgtatccggctacaaacggacaaagtggaactaagcgtaaaccttgtcgttcgatatccgccaataccttttctgcaagctgtgaaccgactcctcttcctccaagggaagcggggacttcggtatgtacaaggtagatttctccattgtttgatttgatatagtctatctcggctatcttgtcatcgatctgaaattcataccgatgtttctcctcattatcgattaatttataatcttctgccataattttacgtattaagtttgattataatataaacacttgaggattgattttgtttataaagaattttccgctagcttacaaggtcattgccatccgtcttgttatctgcctgttatacggacaaccgttctaactgaacggtgaaatgccgcatcaagggggcttcccaagcgatgcgcacaccacgggtgatcgtttctctccgttcgaatacgtttctgagggcggcagctattacgttcatgtgattgtccgtatataccctgcgagggatggcgaggcgaagtaaatcaaggccgttaaagcgattttcgtgagtgatagggtcacggtcggcaaggatgtaaccaatctcgcagccgcgtatgcctgcctccagataaagctcgacggttaatgtctgtgcgggaaattcttctttcgggacatgtgtcagcactttggaagcatcgacgaaaatagcatggccgccggcaggtcgttgataggggatttcgtattcgtccagtttctgggcgaggtattctacctgtttgatacgtgtttccaggttatcaaattctgtattttcgtcaagaccgatagcgagggcattcatgtcccgtccgttcatgccgccgtaggttaagtatccttcgtattgcacgcagaaacctttggcaccttcataccattctttgcgtcgggtggcaatgaaaccgcccatgttgactatgccgtctttcttggcactcattgtcataccgtcggcgagatcgaacatttcacgggtgatttctttgattgacttgtcttgataacctttttcacgcatcttgatgaagtaggcattctcagcaaagcgggcagagtcgaaaagtacaggtttgttgtatttatcggcgatggcacgtacttcacgcaggttttgcatggatacaggttgacctcctgcggtattgttggtaatggtaacaatgataaaaggaatgcggtcggcagattcgcttagtgctttctctaatttggtagggtctacatttcctttgaagggaatttccagttgagtatcctttgcttcgtcaatcgtacagtccagtgcgatggcgtgccgtccttcgatgtgtcctttggtggtgtcgaaatgcgagttgccgggcactatattgccttcatgtaccagataagagaaaagaacattttctgccgcccgtccctgatgggtaggaatgatgtattcgaatcctgttattctcgtaatggtatcttttagtttgaagaaggaggtggcaccggcataactttcatcacccagcatcatgcctgcccattggcggtcgctcatggctcctgttccggagtcggtgataagatcgatgtaaacttgctctgatttgagttgaaagacgttataatgtgcttctttaatccattgctcgcgttcttcgcgggtactttttctgatgggttctaccatcttgattttccatgattcagcaaaaggtaattccattgtcctcgattttagatttttatccgactaaaatactgaatatagatgagatagacaagtttttgatgactttttgtaaaggtgtagataggagaaaatggttttagagaaaacgggagagaggagagtataggatgggaggatgaagaaatgtataacttcggtgtataatgaatatgtgccaaaagccaaagttatttccacggtgggactactgctagcttttggcacatattctttgaaattgtacggtcgattgaatgtgattattaggagtaatcgtttgcaatcgacaggttggttgggagtaagcaggtagtttgtttaagtcaaacgaacactctgtttaggacaatcagaggctctgtttgagtcaaacagaaggtctgtttggaacaattggagcctctgtttgactcaaggtctgatactagtcttcgatgagggtgataccgtcaaggcagaaataagaaggagtcatcggaccatagtcattctttttagttgtagtcaattcgaacttcaatccatcagtttctcccaatgaagtaagatctacccatttccatgttgttacgaaatttgtgccttcagctaaataacattcaactttctgagttttatttagattgtatattgttaacttgaatgagtcattcttatcaaatttgtcgagaccgctaaacatagaactaccttctttcatgctgttgtatgtatatacacaattcgttacatataagccttttatatggtagtcttccgttttgttcttattttcactatccttgaatcgaatagcaacttctttatcgctattagcatctactttatatccggatgcaccaacgataacatatgtgttattattcactccttttttagttatggcacgataatcataaagggagaaattaggacagtcgttgactgtgcaattggtgaatgcaaaactatcgcttccaaatccataagcatcggatgagacgcagtcaaattcgaatatcttattattgtcggtaagcagtgtttggaagtagttagtaatataggtctgcccttcgtattcataactagttgaccattggtctacaggatttttcgtgtcacctaaatccagagtatgggtctcgtaattaggtaaacttagcacatacgtttttgcatcgtcgtcatcgctgcatccacaaaaagcgaatactgataccagtaagaataaagataactttttcatttttgctttcatttaaattattaattgttttattgattagttctcgaaatgtaaatcctctactgtcatgacttccgtggagatttctcctgtccaacctgtattttgatttattgcagtatatatttttataaaatctattttatctagtattactggtatcccttttttatctactgcccagtctattttaaattgacaaaattctgaattataaggatgattatccgcatatccccaaggataacagtatcctacccaggtacctccttcatttattgcattgtctttcaagcgtgttccacggaaagtaatttcatcttcttctatccaattgggatagtaggaatcctgttgatggtaactgttgcgatagacgaacccttctcctccttgattgtcggtccagcggatatcaccattggcaggttgaggacgataataggttatttcgtaattacgggtttccgtatctttcccatattcgcttcctgccagttcataccattcatcgtccggcaatccattgccattttcatcttttgagactaagacaatgcccggttcggcacttcctcccaaagctcccgtaccggtattctgattgtatgaggcattgcctaaaattctgaagtcatattcgcctttactattacggattgactgatggaatccgactgtaatcgttcccccgaatccacctaaagaaataacagacttcttctttaatttctctgttgcacgttccaaaacctgtttggcagagaagccgtcttcgtaggcggaggttgttgtattaatgaactgtccgggggcagggatgtattcgaatactttgttggcaaaggcggaaggcgcattcggatcttccggtgtatcgcctgcctcgttctgtgaagccttgtcgctaaatactactgtattaggatttaagccgatatcatttagacgatattgaagttgcccttgttggttgaagcaaaggacatctcctttgactgtataattgtaagcctccgtgatatacacattcccgctgaaaggattcagctgaatgctgaaaggcgtttggatagccgttccgtctgtgataaagttatcccgtatgacggttcctgcattcaggtcaaatactttgatggcggaatctttagtctgatagtcgtaagtatatagataagcgatggggccgtcgatggcaaagctcagtactttttcatcatacgtagtggcgaccgcatccgttcggctgtcgattttgaccagatgatagtctccggcttcaatgtcagttcctcgtgtgactacatacacggcttcttccagccccggaagtatttttcccggattcggtccgacttctattttcttggtctccttgaaagtcgttatgtcaatcactgatactgtagtgtctacgcccggtcccgaataatccagtccgccggaattggatacatacaatttcccgttttgtacgcagatatcttccgcatttcttccgactgtgacaatctcttcgatctccagagaagtggtgtcaatccttgcgactgtgccgtcataggaacatatatatgccttatccttatcaaacgctatcgcgcggggctgacgtgaactgccattgtcgcgcaacatactgatctgccggatggatttgcccgtagggaagtcaatcacctctacggtgctcgacacattgactactacataaatcttatttccatagatcgctatgtcattggctgtatctcccagtccccgctgattgtttgcactaaagtagttgttcgtacatctttgccgattgaaagaataacgagcgagcgaactattattctgattgaacagtccttcgcttaatatgtacatctccgctgttccggtttcgaatacatccccattgctttcgggtacaatacttggcttatcttccagatcatcgcaagcgataaagaagagtgggaaaagaaaaaaacacttccccaaccgtagcaacatattatataaaagacctttctgcatacctaatacttattacttaatacctattacctaatacctgactcctatcgtcactcttaccgatcttcccggcatggggaaattcttaacgatctcataattcctgttcatcagattcagcacttccaggttgagtgatgctgtaactttctgtattttgaaatctctgtaggcagagatgctgtgatcactgtagctgtccaggcggttgtcgctgatgttttgtcctaacatataccgttttccggagaaaaggaatgaataggaaagattgagccatggagtttctattccggcttgtccggaagcggagacgcgcggggtataggctatctgatgcttgtacactttaccttccggtgagttgggattggagttggtaacgtccagtgcccgttggtaagtatagtttccggaaaggttgatccgtagtttatccagaggctggaggctgaggctggcagttgcatctatccccttgatatccactttgcccagattgaccatactccagatgaataagttcttggtaggagtggctacaatcttgtcggtcactttattatggtaggcgtctacggtggccgacagataaggtatgaagtcgttgatggctttactataagcaatacctatattatattgagtagcactttccggcttcagattgatgtttccggccttgtcgtaatataaatcattgaagctgggcagacggaagatatctttgtagaagaaacggaaccgcagttcttcattatgaaacggcttgagcgagatgcttacattgggagacagcttccggtggttgccggcactacctccgtttttagctttctcgttgatgaccgttgtcagagcagaagcggatagcgtcacccattcattgacgtatttcccggcgaaggctgtcagccatgaatagcgggtgggggagacgaagttctgcaaattggcattcatcgtattgatgctcccgtcagtggacaaggagaaagaaagattgttccatatccggtatagagcggaagcggacaggtaatattcttgctggtagtagctgttgtcagttcctccgacggaggtaagagcatccgggtcctgatagttctgataactccagttccacttggcagaggtctggaatacccattttctgctaaactctttcttgtactggctttggataaaggtgttcttatcccgcagattttgtcgggagaagtcataatataaggtagtggcattgggcaacccccgtgaggactggtaataataggctttcagtctccattgctctttgtcggagagattggcgaaagcgcttatctcagcccgaaggttttctacatccgtattccgacgcttctctttactgacctgaacatcggcatcattcccgtaacgcagggtaaatggataatgtccgtccgaagacatccattcaccgttggcggtcatgctccatttcttgttgagttgttgttccagaaaaagggagggatttactaatccccatgaaccggtcttaaattcggcggctatattagtcggcttgtcttctttgaagtgcggagtcagtgtctgtatgttcagtatgccggcagaagcaaaaaaacgggcaggctggaagatgttgtcgctttgtccgttgttgagcgaaaggcggtctacgttgtttaaggagaaacgtccgatgtctacttgtccggtctggcagtcgctgacggtgatgccatcataggaaacagcggtgtgctgtgctccgagacttcggatggagacggtttttaatcctccgatacctccatagtccttcacggtaactccagcgaaatgttttaccgcatccgatacctgcagggcctgcagattctttaattcgtccttattgaaaacctgcagaggagaggctgaacggacttcacgcgtctgataagggtcggatactatgatttcggggatggagtagatatgtgctgtatccactttttgttgttgggcaaaaagggataaggacaaagcctgacagcagagtagtacgctcatctttttaataaaagtattccttctcattgttttctttcagtctgttcataatgtaaaaaagatgtccgggcgaactcacttcgaccggacatcataataaacttggcagagtttattaattagtacacactttctctgaatcagaatggtgaatgaaatgatggacggattgtccggttcattagactcatcgctttttcctcgaaagcagtgaaacgagtttgcatggtaggtcttctgacttgttcctgttgcgaacgccttcccggaatacccttccagtggctataaagtcgattgctcgcaaccaaaaaatgaacttacagcagcgggactgttcaggactttcacctgattcccttttaattgcttccctcgtgcatgagagttgcaaaccaatgcgcgacaaagatagatagtttatttgtcttttgcaagagaggagcgaaggtaaatccatgactttgaacagctttttaaaaagctttgaatccgaccacctcggttgacacttcacctatcgactcgacattcttcaaaatagcactctgtactttcacaaaatgaatacgttccagcgttacaggattgccattctggtcaacggcgtcatccaggtcaaactgattgtaccggtagttgccgttgtcatcctttgccatgtcgcttccccagttgtcggcatatccttttccgaaatccttgtttttccatattccgccttcttgttctgtccttgcttcgagcatacttcctttcaatgtataggagtcctccttaatccagttcggataatacatctgatcgtgatattgagggagatacttgatgactccgctttctcctttgctgtcttcccaagggatatctccggctgcatccggtctgtggtaagtgacggaatagtcgcgctccggttcgtcacttcctttcagctcgtaccatacgtcgtctgcttttccgttgccattagcgtcttcggatacccatacgatgcccggttcggaacttccggagaagggattgccgataataccgaagtcgtatcctttgcggttctttatttctttcggcattttaacggtgatgtatccgccgaaggagcccagtgagacgtagagtttcttgttgaagcgctcttctgcataagcgtttgcttcttccattgtctggcagtcgaagccttcgttgataaattgccccggtgccggacggtattccagcactttgaatccttgaatttccgtttcttcctcatctttgttgcaggaagccaatagagtggctgctatagccatcagataccaatatcttttcatttttctatgttgatttagttattgaataatatttgtgaagggacgctctcgccacagtctactgtgtggagaactttaccgtctttgctgtaaacgacgattttagattcatctttcagttcttcggtataagttacatagagttctccgctttgttggttcagctgcaatggagcagtaattgaaactcctgattctgcggcaatgaaaggtgctttgagagagtctgaatcgcctaatatatatttatatatagctccgtcggtcgataccagataaataatattctctgtttcggatgctaccatgcctatggtcggacttgaatgatacggtcccttggccggctggaagtttgcaaagactttttctaaagtaaagtcattctttatttttacgatattacatccgttatcagccgattcaagagtataaacattaccgtctttagccagtacaaaattgattttctgtttttgaatgatatctagctctgtaacggcaggagcttctccttctttagctgcgattagctcgtttacatcgtaatacttcactttggactcatctttataagtgtcattgctcagcactttgccattgtagattatgctattatagaaacaaagcatacgctcattcttgatcctgacattgttaagtgattttaggtcaatacgacgtatgccatctcctgtcactaatccatattgttcgttcagaatggtcagaccgcttaggtttgcgcctactacagcggagttttcgtaataaagagtcttggcgtcgacaatgtagaaatgatctcggttcgatgtgctggtgcccacaagcagatagaactttccgttgctgtgaatgatatttgcagagtcgtagttaccaatccccaaagtttttcctgcatttaaagaagcataacaatcttgataagcagttttcttttcggtatcatagaaattgaatgttccgtctgctacgtagaagaatcctttggaaaagttgtggttagagctgaaacttgtgctcatttctacttttccgtatttattcttgatgatacatgtcaggtccgcgcgacatggattgtctattttgtaactaaaggtcggttcggtagaatactcttttccattgaccagccatgaataggtggctccttccggattaagcagttccggagtaatctccaacgtttctcctaattccaacacttggctttctgtcgggaaagttcctttcagtacgttcggataatgtgccagattgccgaggtgcaaatcttcgcaatcgtcgtcgttacaggcggtaaaacctgctgcaaggcaggctattaataaagtggtatatagtttattcatcttgtttcagagtcttgttattagttaaaaatgaatgtagccgggaaataatagccatcgtatgctatttctgatatcttttctcctgtggcggcgttgaatcttaccagaagatttttctgatagtctccggtcaggtacatggccagtaattcgttggtctttggattgacgcggatgcctgcgccatagaatccgtaaccttctttggtgtattcggtcagtgtctcctcaggggcgggatcgtcaaaagtggctttgtatatctttcctcctgcgatgtagtagaatattccttcaggagtgccgcagaaactggcttctctgtaagcaccgaacgaggagggagaataatcgtcacgcattgcaaccttttccagagaaaaatcagcattgattcttaccagattgtttttaccgtctttggtcgtttctacagtatagatatttccatctttacattgtacaaagcgagtaccaccataggttgcaatatctaattcctggaatgcgactttgtctgtaggcttgagatcgggtgaacataattctgcaatgtctatggtatacactttaggacttccccacccggaggagttcacatttaatatgagttttccgttataagcgattccgctacctgttccggtatacgtatttcctaccgataccagtgtaattgtttcaaacgtttttaaattgatacggctgaaatatcctccatgagtaattattccataatcgtcattcaaaccgataaactcataagcttgataattagctagtttgccacagctattttcagcatacagagttttagggtccatcaccaccaactgattatcttcttttgaacagacatacaacttcccattccacaaagtagccgattgtgaggtaactcccagcacatctccgaaattctgattcttatagcaccagtgttcaatgctgttcttctcataattatagaatgaaatacttccggatccgtgtccgaaccatccctcattgataatcagacatcctttggagtaatccgctcccggaaccatcactttattttctaatgtcacttttcccaagttattgctgagttctaaaataactttggaacggccgggatgttcggcgttgaatgtgaatgacgggtctgtcgacatatcttctccattctgataccattgatagtatatatccagcggactacttgccttaggggcatatacatattgttctccgacattgagtgtcaaatcctcttcggggaaagtgccggctttcagagctggtaatccttgtagtttgtcaatgtggtccaggtcacaatcgtctttcgagcaagacacaataacaagcgttgttattataaataataacgttttgaatagctttttacaattcatgttttgtatattaagtaaataaaatatgtccatcaaagtgtccgggcgaaatcgcttcgaccggacacacataataaacttggcagagtctattagtttgtacatactttctctgaatcagagtgatgaatgaaatgatagacggatgtccgggtcattagattcaacgctttttcctcgaaagcagtgaaacggattttacatggcaggtcttctgacttattcctgttgcgggcgccttcccggaattttctttccagtggctttgagtagattgctcgcaacatatctatggaacttacagcagcgggactgttcaggatttacacctgattcccttttaatcgcttccctcgtgatgagagtcgcaaaccaatgcggggacaaagatatatagtttatttgtttctaccaaaaagaaaataacagcagttttgctctcatgctctaacaattcctgcgtatccctttattcatcgctgtttcaagcgtggtagcaagtgtggtggcaggtatgagagcaaacggttgctctcactccggtgcataggatgacgtgacgttttgtagtgttataggttgatttgtaggatgttaacgtctgatacgtcaactattaaagattgacatatcaactattaataattgagaaatcaggtattaaaggctgataactcatctattagtagccaataaatgagttaatgcttcttgaaagaacgggtgaattggagcaactaatgcgattgggttactccggtcatgcagtcaagttactctaattgatagttgctttagaaagttccaaagcgttgaaaccaacggtttcaagcggatgaaactctagtttcaagcagatgaaactttagtttcaaactgaagaaactttggtttcaagccgatgaaactttagttccgagcggcagaaacattttgtttcaacggttggaactgatattggaactacatgttaactattgatgctgcattagatatgcttcaatggctggtgcagtggcatctttaagcaatacagtcttgtctttatccaacagatatagagtcgggatagcctttaagtcatagacctgttcttctttgatagtgaacttcttgtcatatccgttaatccattcattgggaaattcgctcagatgctttttccactcgtccagttcctcatcggggtagatggagagaagtaccaacttcttttcctgtaaaagctggttgatgatgggagcgtttttcagaccttctatggtttctgtgcatgcctgacagccggggttattgataaataacagaagatattccgctttcaactgatataatgaaccttgtgctccggaggccagggtataagtgaagttgagcgctttggttccgatacgatttttctgagccagcttaagacgggcctggggacgtatcttctctgtttcgttcaatacaggagaggctatcattgcttccaataccggtatataaaattcttcgttgcgcatgggggagttgggatcatacagatacttgtccgccaggtcggtgatatatgtaaacaccttcttgtccacattggtccggtcgattacattgcgcatggcttgttgggctgtttcaagcggtacgtggttcagcaagtcgcaataatctgcccacgcttgttccgttacttccggatggtggatatagttggtgtcggcaaagtttacattgtcccaataatgcttggccagaaagtcggcccgttgttccggtgctgtcatcatttgcgggatggcgggcatcttaatagccttaatggtatcttgcggtgtttcgcttttgctttgacttgaagcattcccgtttttacaggcgccaagaagaaggcacagaatgagtataaggcttatgtttgttttcatgacaattggttggtttaaacttactttcggaagcaaaggtatgaaaactatgtgaaaaaacataccgatattccggtaagttttgaaaactggatatgcggcttcgtattttttatcgatacagccgactttgtgtgaatagggataaataatctcttcccttcggatggaatctgcatcgaatttgttatctttgcccgtagcattggttattttttaataaaagctgatatgaacgcacctgttaaaacgctccgtaagctcccgatagggatacaaagtttcgaatttcttcgctcggaaggatatctttatgtcgataaaacagaactggtctatcgtctcgtaacgaaagggaagccttatttcctcagtcgtccccggcgtttcgggaagagcctgttgctttccacgcttgaagcttatttcaaggggaagaaagaacttttcgaaggactcgctatcgagaaattggagcagaactggttcgaatacccggtgctgcacctaagcttgaatgctgagaaatatgacagtagggaacgattggaaagaatgcttgaactgcaactggaaagttgggaagagatgtatggagtagataaaggcacaatgacctactccggacgcttcattaccattatccgacgtgcatacgaacagaccggacgccgtgtggtcgtactcgtagacgaatatgacaaacccatgcttcagacattcgataaacctgatttgcaagaagacttccgtaaaacgctgaccgctttctatactgtactcaaagatgctgacccttatcttcagtttgtctttatcaccggagtaacgaagtttgcgcagatgggcattttcagcacgcttaaccagttgaatgatatcagctttgaccttgagtacaacaccctttgcggcatgacacgtgcggaaatcgaaaccgtttttgtgcctgaattgcaagaactggctctccagactgaaaccaattatggcgaagccgtagagcaactcacccgccagtatgacggttaccgcttcactcctgagaaaggatttactcccatgttcaatcctttcagtgtgctcaacgctcttgccaagtcgcgtttcggtgactattggtttgctagcggaacgcctacttttttggtagagatcctaaagaagacaaatttcgaccttcgcgaattggacggtattgaagtctcttccgcctccttgagcgacgacagggcgaatatctccaatcccgttccgatgatttatcaaagcggatacctgactataaagtcgttcgaccaacgttttcgtacatatacgctggggtttcctaacgaagaggtgaaatatggtttcctcaattttgtcgcccctttctatactcctgtcgcatccaccgataccaccttttatatcgggaaatttgtgcatgaactggaaacgggcgaaacggaagctttcctcactcgtctgtcctgtttcttcgccgattttccttacgaactgaatgagaaaacggaacgtcattatcaagttgtattctatctcgtcttcaaactcatggggcaattcacgcaagcggaagtccgtaccgctatcggtcgtgccgacgcagtagtaaagactgcggactacatctatgtgttcgaatttaaactcaccggcaccgccgaagacgctctgaagcagattgatgaaaaaggttaccttttgccctacactgtggatggcaggcgactggtgaaagtcggtgtgtcctttgatgccgcgaaacggaatctgggagagtggctgattgtttgactgcactgtgaataaagaaaaaccaagctgtttatttctctttcgccagcgtgaagacaaattccagtccgccgccttgattattcttggcagaaatgtttcctccgtggatgatgacggcattctttacgatggcaagccctaaaccggttccgccgagtttgcgtgaacgccctttgtccacccgatagaaacgttcgaaaaggcggttcagatgttccggagagacaccgatgcccgtatctgcgaagctgaaataatagtaattctcatcttcacggaaacagttgatgtttatctgaatattggttccggcgtatgcgatggcattgtccatcaggttacggaaaatggagtagagcagagagtaattgcctttgatctggatacccttctttagtgaatccacgatgctaatgtgcttttcttccagttccagagaaacttcattgatgatgttccctaccagtacgctgatgtctacccgttccatgtctatcatgttggcggcttcgtccatgcgggtcagtacggatatgtcgcgtagcagccggctgaggcgattgctttgtgcgtagcaccgttcgaggaacgtatttatcttgtcacgtgagatattctcgttattgacaatcgtttccagataaccttggatactgcttacgggagttttcagttcatgggcaatgttctgggttaattggcgcttcagacgtacctgctcttcttcctgcgtgacgtcattgatcgaaatctcgaagctggcgtcctgaaagatgatacattccacgataaaggtgcgtccgtttttgttgattgtgacggacatacgcttttcgtcttttccccgcgagcgttgctgctggttcttgttgatgaaatgaatgatgtctttcagttcgctgatggcgaatacttcctctgtcgtttccaggttagagtccgaaatcaggttactgtattgagtaaagaggttgttgaccagaatctcttttttgtctttggtgaatatgcccagcccttcatgcgaaatctgaagatgggtaatcagtttctcgcgttcgatgtagagtgcctctttcgtttcgtgcagacgcttgtatatctggatgatgtgctgcgaaatctctcccagctcattatgcggaaaagcggactgcatcgccatctctatcggttcgttacggtctgcacgcatggcaaactcgcggagctggctgatagaggttcccagtttgttggtgaatttgtagaagatcaccatgagcaacagcgacacaatgaccgtaaaccataagtaatgcgggtctgcctgcagattattgatgaggcttacattatatggcagtgccgagcggatgatataatctccgtagcgggttgccgaatagaaatacggtagcccggtggtctccgaggtgcggcgtacgtcaaaaccggttccgtctttcaaggctttctgaacttcggggcggttgagatggttctccagttgctggtcggtagtctgataactgtcatagatcacatttccctgcaagtcgatcagtgtgacgcgcaagtcctccaatgcgtggtcgcggatatacttttcagtcgtttcttcgatggcgggattactgttcagccgttcgtacaagcggctgttatagttctggagctgtgtgttgagtaactcgactttatattctctttcgcgttgatactggtaggcgatgaaacaaaaggcaaataccagaaacagcgagatcaccgaaaggaataacttccggctgaaagagaggaaatgtttttgcttgacaggtagattcatacttcttgattattcggcttcaaagcagtatccgtatcccaggcgggtaacgatgcacttgccatattcgccaattttcttccgtaaacgggtgatattcacatcaatggtacgatcgagtacgtatacttcgtcgctccagatgcgtgccagaatgtcttcacgggagaagacgcgtcctttgttctgcaccagcagaagcagtatttcaaattctttcttcgtcaactgcacttcttcgtcatctatgcttaccttcttcttggtgatgtcgatcacgagtgactggtaagtcaggcgttcgggcgccttttccgtctccatcgtggcggtacgcctcagtacggctttcacacgggcgatcacttcgcgcagggagaaaggcttggagatataatcgtccgctcccagattgaagcctgttacagtatcgttttcggtatctttggctgtgatgaagatgatgggcactctggctgttttcttgtctttcttcagcatgtttgccatcttgaaaccggagatttcccccatcatcacgtccagaagaatcaggtggtaactgctgatatccatcttcagagcctcttcggcggagttggcggtatccacttcataaccttcgttttcaagattgaatttcagaatctcacagaggtcttcttcatcgtcgacaactaaaatacggtaatcgttcatatgatatatgtattaatgtgatatgacaaagttaagcttttttttatttcgggacaaagatgagaagactttgttacgggcggatgaaacaaatattacaatcgtattacattccgctgaatgcgggcatcgggatgatatttgaaagtttttatgggatatgcgaggaaaaaccgtctgttatttgttatctttgtgtagcgataggataataaatacacagtttgcagatcatgataaaaatagacttgaaacgatatagacgcgaagtggtaggaggggtgattgtactgcttcttcttatcgggggaatctccgtctttaaatatacttcttttaattccggctttgagatcgtagacgatctgggaggaaatatctttccgtcggccatcctgtcggtagccactacggacgcgcaggtgattactccttcggattctacctgtctcggaaatccgaaatcgtgcatcgccgttcgggtgaagtcaaggactgcttatagccgggtgcggatagaggttgccgagacccctttcttttcccgttccgtgtcggaatttgtgctgaacaagccgaggacggaatatactatttatcccgatatcatctggaattacgaggcactgaagaataacgcacaggcggaaccggtgagcgtagccgtaaaagtggagatgaacgggaaagacttgggacaacgggtacgtacgttttcggtgcgtagcgtcaatgaatgcctgttgggttatgtggcgaacgggacgaagttttacgataccagtatcttttttgccgcatacgtcaacgaagagaatccgatgatcgaccagctgcttcgtgaagcgctgaatacccgcatcgtgaatcgtttcctgggctaccagagcacggccaaaggtgcggtagacaagcaggtgtacgcactttggaacatcttacagaaacgtaagttccgctacagttccgtatccaatacgagcctttcgagcaatgtcgttttctcgcaacgtgtccgcacctttgacgatgcgctggaatcgtcgcagatcaactgtgtggacggcagcgtactgttcgcttcgctccttcgggctatcaatatcgaaccgatactggtacgtacaccggggcatatgttcgtaggatattacaccgacaactcccataaggacatgaacttcctcgaaacgacgatgattggtgatgtagacctcgacgacttcttcccggatgaacaactggactctaccatggtcggcaaatcgcagaacgaaatgtcactgctcactttcgagaaatccaaacagtacgccaacaaaaagtacaaagacaatgaagcaggcatccattccggaaagctgaactatatgtttctggagatttccaaagaagtacggaggaaaatacagccgataggaaagtgaaattcatttttaattcgtatttttgcccaagtaatcatttaatgaaaaaggatgcaaggcaagaaatttatctcccccggagcatggttttcgatgaattatccgtcggactggaacgagtttgaagatggcgaaggctcttttcttttctataaccccgatgtatggacgggcaactttcgtatatcagcttttaaaggcaacgcctcatacggtaaagatgccatccgtcaggaactgaaagaaaacgattcggcttcattggtgaaaatcggtacatgggactgtgcctacagtaaagaaatgtttcaggaagagggcacttattatacttctcacctgtggataacaggaaccggcaatatcgcttttgaatgttctttcaccgtacccaaaggcggaagcaccaaggaagcggaagaggtcatcgctacactggaagcccgcaaggaaggcgagaaatatcccgcagaactgattcccgtccgcctatcggaaatctatcagatcaatgaaggctacgagtgggtagtatctaccgtcaaacaggaactcaaaaaagactttcagggagtggaagaggacttggagaagattcagcaagtgatagacagcggtaagatcagccccaagaagaaagatgaatggctcgccatcggtataacggtatgcgcgattctgactaacgaagtggaaggcatggagtggaaaaccttgattgacggcaatcgggaagtccccgtactcgaataccaaggccggaccatcgacccgatgaaaatcgcatggagcaaagttaaggccggccaaccctgcaacattgccgaagcatatcaatcggcaatcgatcatcactaaatcacgaaccagctaatcactaaattacgtggcagtaccttatttacaagtagacaacctgaccaagtccttcggcgacttggttctttttgaaaatatatcttttggcattgccgaggggcaacgcgtcggattaatcgccaagaacggcagcggaaaaacaaccttactgaatatcatcgccggaaaagaagggtatgacagcggaaacatcgtcttccgccgtgaccttcgtgtggattatctggaacaagacccgcagtatcccgaagaactgaccgttctcgaagcctgtttccatcacggcaacagcaccgtcgaactgattaaagagtacgaacgatgtatggaaaccgaagggcatccgggactggaagacctcttggcacgcatggaccaggagaaagcatgggaatatgagcagaaagccaagcaaattctgtcccaactgaaaatccgtaactttgaccagcaggtgaagcagctttccggcggacagctgaaacgtgtagccttagccaacgccctgatcaccgaaccggatttgctgattctcgatgagcctaccaaccatctggacctggacatgaccgaatggttggaagactacctgcgtcgcaccaacctgagcctgctgatggtgacgcacgaccgttatttcctcgaccgtgtctgctcggagattatcgaaattgacaatcagcagatttatcaatataaaggtaactacagctattatctggagaaacgtcaggaacgcatcgaagctaaaagcgtggaaatagaacgtgccaacaacctctatcgtacggaactcgactggatgcgccggatgccgcaggcacgcggacacaaagcccgataccgtgaagatgccttctatgaactggagaaggttgccaagcaacgtttcaacaatgacaacgtaaaactggaagtaaaggcctcttatatcggaagcaagatattcgaagccgatcatctgttcaagagctacggcgacctgaagattctggatgatttttcctatatctttgcccgttacgagaagatgggaattgtaggaaataacggaacgggtaaatctacttttatcaaaatattgatgggacaggtcaaacccgacagcggaacggtggatgtgggcgaaactgtccgtttcggctattactcgcaggacggtctccagttcgacgaacaaatgaaggtgattgatgtcgtgcaggatatagccgaagtgatcgaactggggaatggaaagaagctgacggcttcgcaattcctgcagcatttcctgtttactcccgaaacgcagcatagctatgtctataaactgagtgggggagagcgccgccgcctttacctgtgcacggtgctgatgcgtaatcccaacttcctcgtgctcgatgagcctaccaacgacctggacatcatcactctgaatgtgctcgaagagtatctgcagaacttcaagggctgtgtcatagtcgtttcccacgaccgctactttatggataaggtagtagaccatctgatggtattcaacggacagggagatatccgtgacttccccggaaactatagcgattaccgtgactggaaagaagccaaggcacagaaagaaaaggaagcggaaaagccgcaggaagagaagaccgcccgtgtccgtctgaacgataagcggaaaatgagcttcaaggaaaagcgtgagttcgaacaactggaaaaagaaatagcggaactggaagcggagaaggcacagattgaagaactgctttgcagcggaatgctttctgtagacgaactgactgaaaagtcgaaacgtctgcccgaagtgaatgatctgattgacgaaaagaccatgcgctggctggaactgagcgagatagaaggctgacatgaatctgaacggaaagaaactgtaataactgaaacaacctgataataaccgaaataacatagaccgatatgacaaacctgaccaattaccatagtcactgcttatattgtgacggacgagctaatatggaagattttatccgttttgccattagtgaaggcttttcttcttatggcatttcttctcacgctcctctgccattttctacagcatggacgatggagtgggaccggatggatgattacctttccgaatttgctcgtctgaaggagaaatatgccgataaaatagagcttgccatcggactcgaaatagactatctgaatgaagagagccatcccgctatccctcgttttcaggaattgccgctcgattatcggattggttctgtgcatatgctctattctccgcagggcaaagtcgtggatatcgatacccctgccgatatattccgtcaattgatagatgcgcattttgaaggtgatctcgattacgttgttcacctttattataagaatctgctccgtatggtcgagctgggaggttttgatatccttggtcatgcagataagatgcactataatgcctcttgctatcgtccgggattattggacgaaccgtggtatgatgcgttggttcgcgattattttgcagaaatagcccgtcatggatatatcgttgaaattaataccaagtcttatcatgatttgggaactttctatccgaacgaacgctatttccctttattgaaagaattgggtattcgggtacaggtgaatagtgatgcccattatccggaacggattaataacagtcgtgccgaagcattggcagccttgaagaaagtcggttttgacacagtagtggagtggcacggcggacagtggaaagatatgcctctgttacaataaaacagagcttctgtttataataaatgcaggctccgtcaactgctgacagagcctgcatttatctataacagagcctctgtttcgatcccctattccgtccttttgcaggcattcgataacaggaactcattcaaagcttcttcataattcccatgaatcataatatgatgattgcctagcgggtttttcaggaaataatccgccggagtattcatgcggatacgcacctgcgtgcggcacatattgatataattcgtattctcggttagagttccggtagacaggtaatactcatccagacattcgcctccgcattttacgatagtcacgtcacctgtcgggagcagtccttgaatggcgatacctttctctgtctcaaaatgattgcggataatatatctttccgtctgtttgagtcctatagtgcaatgtgccagtattaattcattggttcgcgtattgatggtggatggatttgccatgaatccttcttttcctgtcagcgccttaactgccagaagagtgaagatagactggagatctccctcacagcctgccatgataccgtcatcattcagcaatgacaatgccagacagccggtcgtatcaatttgatcgatcagtttgaagcagcttaatgtcagcgcttccagcttctcttcttcgcaaattctcttgatggccctgtataatcgcattgctttgattaaatcctcgggagttccctcgcggcaggcaagcgcctgcgaagcaacggcggcgcaggacgcgcctacctgatcatctgtgatttgtttaaaatgttcataaaccctttccagcggaatatctatatattcgattccccaacggcgttttgccagaagataatccacattgctggcaaccagccacgaagaaggagtaccgatgactccgatacgcttgccgaacaaagaacgctgcgcgcggaaattattatatagtatatgtacacgttgaataatagacggtaattctccatgaagaatttcactcttcattccccttccacggagccatgtagatatttccaatgccgcagcaagtgagttctgcatgccatcggccaataaaatggcggggcggggaagacgttcgaagtgctggatgaccagtctttccacacctccggtagcgataaaaatgattttgaaatcatcactgcccaacttatccatatcttgataatcgatgagtttgacagtgtaatatttttcaagttcactcagaattgcttcgtgcgaattgcgcagcgaggcttgtttgtgaagtattgaagcaaatgagataaggtgtatggtcattatgatattgttttaagttttccgtattacaaatgtatagctttcttttcatttttccactacgtttttacccttgataaggattttaaagtttttatgtctctgtattcaaattattgcgtacatttgcagttccaaattaaaaaagtaaatagtaattagtaatttgtagttaaaattatgccaaccatatccattcgcggaaacgagatgcctgcatctcctatcagaaaactggctcctttggcagacgctgccaagcaacggggagtccatgtgtttcacctgaacatcggacagcctgacctgcccactcctcaggccgcgattgacgcgatacgcaacatcgaccgtaaagtgctggaatatagccccagtgccggaaacagaagctatcgcgagaaacttgtgggatattatgcaaagttcaacatcaacctgacggctgacgatataatcattacatcgggaggttcggaagcggtacttttttccttcctttcctgcctgaatccgggagatgaaatcattgttccggaacctgcatacgccaactacatggcatttgccatctctgccggagcaaagatacgtacgattgcaacgacgattgaagaaggtttctccctgccgaaagtagagaaattcgaagaactgatcaatgaacgtaccaaggctatcctgatttgtaatccgaacaacccgaccggttatctgtatacacgtcgggaaatgaatcagatccgtgacctggtgaagaagtacgacctcttcctcttctctgacgaagtatatcgtgaatttatttataccggctctccttatatctctgcctgtcatctggaaggtatcgagaataatgtagtgctgatcgattcagtttccaagcgttattcggagtgcggaatccgtatcggtgcattgattaccaagaacaaagagatacgtgacgctgttatgaaattctgtcaggctcgtctgagtcctcctttgatcggacagattgccgccgaggcttctttggatgctccggaggaatattcgcgtgagacgtatgatgaatacgtagaacggcgtaaatgcttgattgatggattgaaccgtattccgggcgtttattctccgattccgatgggggctttctataccgtagccaaactccccgtagacgactcggacaagttctgtgcatggtgtctttctgactttgaatacgaaggccagaccgtatttatggcaccggcttccggtttctatactactccgggctccggcatcaatgaagtgcgtatcgcctacgtattgaagaaagaagatttgacccgtgcgcttttcatcctgcaaaaggcgttggaggcgtatccgggaagaacggaataggtattaagtaataagtattaagtaataggtaataaccgtagacgctgattggcgtatgatgtattataaggttgataattatatcataaggtgatgtcttaatgcttaatataatacttaatccctaatccctgatctctaaataagctacggctattacttattacctaatacttaatacctattaaagaattgtcgttatctctttttatagcccgtcgtatttatcgcgagagcgatggtggaaaacaggtttcacgtcctgcggtcctcattgctatggctggtattgccatagggttggctgttatgattattgcggtggcggtagtcatagggtttaaaagtgaggtaaggaataaagtcatcgggttcgggtcgcacattcagatagcgaatctggatgcggtcaattcttatgagactcatccgattgcggtgggggacagtatgatgactgctcttgccggttatccccaagtaagccatgtgcaacgttattctaccaagccggggatgataaaaacggatgatgcttttcagggaatggtactgaaaggtgtcggaccggagtttgatccgagttttatgcaggagtatctggtggaaggggagattcctgcgttcagcgattcggcttcgagtaatcaggtacttatctccaaggcgctggctaccaaaatgaagctgaagctgggagataagatatatacctattatattcaggataatatccgtgcccggcgcttgacgattgcaggcatttatcagaccaatttctcggagtatgataatctgtttctgctgactgacctttatttggtgaaccgtctgaatggctgggaaccggagcaggtgagcggagtggagctgcaggtgcgcgactatgataaactggaagatatcacttacgagatagccgttgatacggatagccagcgtgataagtttggaggcgtgtattatgtacgcaatatagagcaactgaatccccagatatttgaatggctcaatctgcttgatctgaatgtatgggtaatccttttcctgatgataggagttgccggctttaccatgatttccggtttgctgattattatcatagaacgcaccaatatgatcggaatactgaaagcgctgggagccgataattttacgattcgcaagactttcctttggtttgccgtctttctcatcggcaaggggatgctttggggcaatgcgattggactggcattctgttttatccagtcccaattcggaatatttaagctcgatccggagaattattatgttgatacggtatcggtttctttcaatgtctggttcttccttttgatcaatgcaggtacgttgctggcatcggttctgatgctgatcggaccttcttacttgataacgaagatcaatcctgcaagctccatgcggtacgagtaatcttctctttttcttttctttttttgctgcaaaaataatttagaccgtagcgtgatgtagagtgaataatatgtctatatttgcgcccgatttacttaatatcctcttgtaggtttaatttttaaccattatgaataatgtgttaattctgttggataatccggatgactggaagccgtattgtgagacgaaaagtatcctgactgtttccgactatctgaagaacaagccggttgaaaaagaccggaagttagttattaatcttagcaatgattacagctataactccgaagggtattactgttcgttgcttgcccagacgagaggacaacgggtgattcccgatgttgacatcatcaacaaactggagacggggacaggaatccgcatggaccgaagtctgcaggcgttgtgttatcaatggattcagaagaacgggatcaaaagtgatatctggtatctgaatatctatttcgggaaatgccgtgagaaagggctggaaagagtggcccgcttcattttcgagaactatccctgccctttgttgagagtcgctctgaacactcatccgaagaatcagattgaaagtattcagttcttgcctttgaaccggttggatgatgaggaacaggacttctttgccaatacgctggataactttaataagaaaatatggcgtgcgcctaagtcggcaaaagctccgagatatagcttggcggtactgatcgatccgaaagagaaatttccgcccagcaacaaaggcgctttgcataaactctccgaggtggccaagaagatgaatatccacgtcgaaatgattacagaggatgatgccatgcgtctgttggaatttgatgcgctgtttatccggacaacgacatcgctgaatcattatacattccatttgtcacagttggccgcccagaatgggatggtcgtcattgatgatccgttgtctatcattcggtgtaccaataaggtttatctgaaagaactttttgagaaagaaaggattccggcaccgaagtctacgttgatttttcagtccaatgagaactcgttcgaacagatcagtgagcaggttggtgctccttttatcttgaagataccggacggttcctattccattggcatgaaaaaggtgtccaatgaagaagaactgaaaacaagtcttgaacttcttttcgagaagtcggctatcttgttggcgcaggcatttacgcctacggagtttgactggcgtgtcggtctgctgaacggagtacctttgtatgcctgcaagtattatatggcaaaaggtcattggcagatttactgccattatgattcgggcaggagccgctgcggactggtggatacgattcctatctatcaggtgccgcgtgtggtactggatacggcgataaaggctgccaatctcatcggaaaaggcttgtatggagtggatttgaagatggtcgatgataaggcttacgtgattgaaatcaacgataatccgagtatcgaccatgaactggaagatgcgattatcggtgacgaaatgtattaccgtctgttgaatcactttgagcaggcgctggaaatgaaacattattaatgatggaaccaacgatacacctccgtcaggcaaaagcgggagacattcctgccattctggagatagagcaggaatgttttcaggaagatagtttttcgagagaacagtttgtttatctgatctgccgttcaaagggcaccttttatgtggtggtggaacaggagcggataatcgcctatgtctcattattgtttcatgcgggaactcgttatctgcgaatatattcgatagccgtccatccggactgcagaggaaggaagctgggacagttgctcatggagcggacgattgagacaactcttgactgtagggcggtaaagattacgctcgaagtaaaagagtcgaatacgcctgccatcaagctatatatgaaaaatggctttattcccgtgggagtaaagccaaactattatcatgatggttcggatgcgatttatatgcagcggcacatgtaatcagcagttgcctatcttctcataaagtctcctttcctgcgtaaggagcggtaaagtttgaatttgagcgactggatgggctggaggatatcgaaaaccggcagggagaaatatttcctgtctccgcccatttctttggctgtccgattaatgatgattgcctgtacggtatagcggaacagccagatcagtaatgcaattccggcagccagccaatggttgttgaggatgccgaatacaagacccgcgatgcaggcagcgtaaaacagcagacgggagaaagtctcgaatcctaacaaatagcgctgtacaccgtgataaaagcgtgcggttgccatatagcttatcttttcttctttccattctttgtagctgtataccggttgtatccgcatagttgcattgatatccgtttctacgcgtgtgttggatggggtggctatctggttgatgaataaatcatcttccccgcgttgcaggttcagataagtggaatagccttttctctggaagaataattctttccggtaagccatattgcggccgatgcccatgtatggctttcctgccaatgcaaagcataaataacgcagagactggaataacgtgtcaaaggctacccgtttgtgcagccatcctttggtccggtcgtaaccgctgtatcccagcactacctgagtctgtgaagtgaagttacgtgccattagtctgagccaatccttgcttgcaggcatacagtttgtttctgtaaataccagccagtcgtgtttgctggccttgatgcccaatgtcagggcaagtttcttatgactgatgtagcgtgcgctgtcgggagtgaagctgtgatagaggtgaggatatttctcttccataaatcccagtacatcctctgtctcatccgtagaagcatcgttgataacaatcacttcgaactgcggatagtcttgttcgagaatggcaggtaagattttacgtaggttatcagcttcgttgcgtgcacaaagaatcacggaaagcggaggcatctcttgtgtgaaatgcactgcttctttgcgtacagccttattgcgggcatgtatccgattgtacaagccgaaataataaatgagctgaatgataaaaagaatacctgccgccgataaaagaatcagttcgacagtattgaatgtaaatgcttccattggatataagtgtcgtttttacgactgcaaaagtacgcatttttttggtagctccgtcatctcgcaggaaggttatttcgtaaatccagatattctttcttgaacatgtcgacgaatagaaagaataatgaaagcagtaacggaccgaagatgactcccataaatccgaacaacggcaaaccgataacgactccgaatatcgtaatcagcggatgggtatccgccattttcttctgcaggatgaatcggatcaggttatccgactgagatatgactattccaccgtatgcggcgagtccgatagcgttgaaccagtctccggttacggcaagataggcagctacgggaaaccatatcaaggcagttcctaccattggaatgatggtggcgaagcaggtcaggaatcccaataccaggacattgggtgctccgaagataagataccctatcatggcgacccctccttgaataatggctaacagaggtatgccgatggcattggaacgtacaatcatattgatttcgtgaattacttcctgtgtattcgcttcattgaacgggagaatgtcattcacataagcttccatcttttttcctcctatcagcataaagtatagtacgaataccatgacaaacagattgatggcaaggctgctgatgctttccattattatttgtccgatgcggggtaggatggagacaatgaatgacaaggtatcttttcccagcacatcataacccgttttttctttgataaactctgccacctgctgcatcggggcaatgaatgtttgcgggtccagattgatgtcctgaagttggtttaccagtagccagattgtcagtccgagcggaaccaaaaataccataaccgtctctgccgtaatcagcaatgcggcaacactgcgtttcagtttccacttttccgtcaggtgcgtcatttgtgtgcgtaccaaaatataaatagtgagtgctcccagcaatcctcccaaaaaaggagtgatctgacggaagatgatgattcccataaatagtatgatgacgatgagggaatatttccagtattgttctttgatgctcatattatgtatttagatattctgctttataaacaaaagaacagtggaaaaagtttgaatgtccggtatgaggtttacgtatgttgtttttaagggagctcaatatgaaaaaccgtttttccggctctgctttctttgatagccaaatgcccttcgtggcggcggataatttctttgcacaggcttagtccgatgcctgtaccttctgatttagtcgtaaaaaaggggatgaatactttgtccataatttcgggaggaataccgggaccattgtcggtgatgtctatgactatatgttcgtcttgttctgcttgcagggaaagctctccatgcggatgcccctccaatgcctgcatggcgtttttcaacagattgagaaacacttgtgacagttgcttttcgtctccttcggtcatcatcggttcgggggagcaccggagtgtaaaggagatattgttttcttgaaaattggtttgaagcagttcctccagattgtgtaataagtcggatagggaaaagagacgcttttcgggctgcggaagataggacagatgccggaaagattcggtaaattccatcagccgttcgctttgcgcctgaataatgtgaagcccgcggattcctttctcgctgatttccggataggaagccagtgtctgagacagtgagataatgggagcgatcgtgttcatgatctcatgagtcaggacatgactgagtttgctccatgattcactttcgttttcgttgagccggtcgtcaatgtcttgtatggaaagcaaggtgattgtttcgtcttgtagtttcatctgactttgggagaggctgagcctttttctgttcttctcattctgcaggatattttccagttgggaatatagagtcagtgattcgatgtttagtaaggtcaacgctgtgttgttgacgaagattattttcttggagttgttccaggctatgattccgttgggtactttctccagcagagaccggtagaaatgttcctgtttctggtagtccattttggtttgtgccaatagggcgttgatccggttcagtgaacggttcagctgttgttgctcttcgtttattccttgctcggggtagctgaatgtattatctctgtcctcgatggcatcaaagaaaagccggagtttccggttgatgttattgagataagtgactattccgccgatttgaaacaaggagcagatgattagtaacgtaccgatgatgatgccacgttgggagatgatgagccacagccctgttcccgaagttgcgaggatgagcaggatacgaagcaatatggtccaatagatatgtcggctgaatatcatcttgttcagggtttgaatcgtttcagtttattatagagagtttgtcggctgatgcctaattgttcggcggcggctgtcagatttccattgttttggaggattgctgtttcgatggcttgccgttctacttcctccaggttggggacgacacttgccgtctgaggtttccagctttgctttaccagaatatctttggggcgtatcacgttgccttcgcataagatcaccgctttttcgatggcgtgttgcagttcgcggatattgcccggccagtgataggagcgtagtttctcaatcgtttgctcgtgcatccgtatgtccggccgttgatatttggaagtaaaacgacggaggaaagtatctatgaataataggatatcgtctccccgttcccttaaaggagggatttccagatgaatggtgttgatacggtagaacaaatcttcccgaaacagtccttgctttaccatttccggaatatctttattggtagcagagatcagccggatatcaacgggaatcactttgttacttccgattcgggtgacattccggttctgtagtacagtcaatagtttggcttgcagtgcaatggaaaggtttccgatttcgtccataaagagggaactgccgttggccgcttcgaattttcccgggcgactttcgtatgcgtcggtaaacgctccgcgttcgtgtccgaacagttcactttcgaagagtgattcactgatagcgcccatatcaatgccaagcatttgacgggaatttcggggagataaacgatgtatctctttggctaacatctcttttcctgttccgttctctcctgtgatcaggatgttggcgtcggttttggctactttcgtgaccactttaatcaactggagcattgcgggagagtggccgatcaacatttccggtttgctcggtttctcggtatccccctgtttgccggttgcctttgaagcgcttttggctttgctgttgttacttttataagcctcctttatcttccgaatcagaatctgattatcccaaggtttgagtaaaaaatcagtagccccgttttttagtgcttttaccgccaattcaacgtctccgtaagcagtcagcataaccaccggtaaagatgggcggatttcgtggatttgttttaaccagtacagtccttcattgccattgtttatgccggcagagaaattcatgtcaaggataacgacgtcgatagaggtggtagtcagtaacgtggtgatttgattgggattggcggcggtgcgaactgtaccgaactcattttcgagcagtaactccagtgaagctaacacgcttttattatcatctactattaaaatagttccgttttccatatctaagattgggggtatctatcaggttgaaccatgctttaagtttgggggtaaagatattcgtttttgctttcctctgcaagcgagtgtccaataattagacgttttcgggcatatttactgcaaggcttacttaaatgcccgaaaattgttcccgaagaatatgaaataatggataacgtccaaaagttggacgttgcggtgtgtaataattggacggatgcaatgcaatcgtattggtcatttggttaataatcaattacttaaaaattgtggcatcctatttgccttctaatcatcgtaacacacaatcgcatatattataaagaatgaaaaactttttctttttgtccttattcttattaccgcattttgtgcaggcccagtccggcatgactttggatgagtgcattcgtctggcatggaagcagaatccttctgtgcggaacagtgtgatagatataaaggaggcacgggcagattatatggctgctgtcggtgcttttcttccccgtgcagcggttaatgcagaaacagggaaacgctttgggcgttctatcgatccggatacgaacggatataccaacgaaacttttgaagaagggactgtggggcttgatatgactctttctctttttgaaggcttttcacgcattcatcaggtacgcttccggaagatgaataaggaacgtagcgaatgggcattgaaaaataggcagaatgaactggcatatcaagtgacggatgcttattataaactgattctggagagaaaactgctgaatcttgctttagaacaaagccggttgagtgagcggtatctgaaacaaaccgaagcctttgttgagttgggattgaaatccgcttccgatttgcaggaagtcaaggcccgcagagaaggggatatctatcgttataaatctcgtgagaatacttgccggttggccttattgcatctggaacagctaatgaatttccaacccggtgatacactcgttattcaggatactattgtggaagcgaatcagttgcccttgctttctgttccgtctacggaaacactttatgcccaatcactggaaatacttcccgtcatgcgtatgattgatttgaaacgaaaggctgcccgtaaagagtatgcgatggctggcggaactttttctccttctgtctatgcccgctttacggttggttccaatttttacaatacagttttttctgccagacagttgcgggacaatataggaaaatatgtcggcatcggtatttcgtttcctttgctgagcggattggaacgtctgactcatcaacggaagcagaaactaaacctgtatcgcttgaagaatgaagaagaactggaaaagcaacagctatataccgatatagagcaaacacttctttccctacatgccggatttagtgaacatcaacaggcattgcaacagcttgaagcagaagctctcgtactgaaagagtctgaacgtaaatgggaggaagggctcatttccgtctttcagctgatggaagcccgtaaccgttttatctccgccaaggcagaactggttcgtgtacgcctgcaagtggaaatgatgaggaaactggagaaatactatcgggaggggactttcctgtaaaacggagtctgtgccatcggaacaatcatttaataacaaccctattttgaatatacctttatggatacacctgttgaacgcaaacccggcataaatcgcaaacacctttatacgatcggtggtgtggcgctgggaatcgctgtcattttatattttatttttagagatacggcttcctccatgacagttgagaaagaccgtctcacgattgctaccgtcaagcaagcggagttcaatgattatatccgtgtgatcgggcaagtgatgcccagccggattatctatatggatgccatagaaggcggtcgtgtggaagaacgtttgaaagaagaaggagctatggtgaaagcgggcgatgtgattctgcgtctcagcaacccgttgctgaatatcggaatcatgcagagtgaggcagaccttgcctatcaggaaaatgaattgcgcaatacccgcatcagtatggagcaggagcgtctgcaactgaaacaggaacgcataggcttgaataaagaacttacattgaaaaaacgccgttatgaacaatacagacgtttggtggaggagcaactgattgcccgcgaggattttcgtcaggcagaggaggagtatgaagctgccaaagaacaactggcggtcattgacgaacgtatccgtcaggataatattttccgtgaaagccagatcagcagtctggacgagaacatacgcaacatgaaacgcagtcttacgttggtccgtgagcgcttggaaaacctgaagattaaagctccgattgacggacaggtaggaaacttgaatgcgcaggtcggacagtccatttccgcaggagaacatatcggccagattattactccggacctcaaagtacaggcacagatagacgagcattatgtggagcgtgtacttcccggacttcctgccgactttacccgtgacggaggaacctataaactggaagtaaccaaaccttatccggaagtgaaagaagggcagttccgtactgacctggctttcatttcggagcggccggagaatatacgtgccggacaaacttatcatatcaaccttcagttaggagacccggcacaagcgatccttgttccccgtggcggattctttcaaattaccggagggcggtggatgtatattgtcgatgaaagtggtaaatttgccacgcggcgtcctgtgaagatcgggcgccagaatccacagtattatgaggtgacggaaggtttgtcttcgggtgagaaagtaatcatatccggttatgagttgttcggagacaatgagaaactaatactaaaataaataaaaagaatcaccatgattaaaacagaaaaactgtctatgcttttcactacggaagaggtgcagacgaaagcattgaacgaagtcaccttacacgtagaacaaggagaatttgttgctataatgggaccttccggatgcggcaagtcaacgttgctgaatattctgggcacgttggattctcccacttccggctcttatttctttgaagggaaacaggtggataaaatgaacgagaaccagctgactgcccttcggaagaataatctgggctttatcttccagagtttcaacctgattgacgaactgacggtatacgaaaatgtggaactcccgcttgtctatatggggattaagactgcccaacgcaaagagaaagtgaacaaagtgctggagaaagtaaatctgctacatcgtgccaaccattatcctcaacagttgtcgggcggacaacagcaacgtgtggccattgcccgtgcggtagtgacggactgtaagttgttgctggctgacgaaccgaccggaaatctggattcggtgaatggcgtggaagtgatggagctgttgagcgaactgaaccgccaggggactacgattatcattgtcacccactctcaaagggatgcgacgtatgcgcatcggattatccggttgttggacggacagattgtatccgaaaacatcaaccgtccgttagaaaaaagtacgtcctctaaaaacgaagctgtatgataggaaattattggaatagtgcctatcggaatctgatgaagcggaagaagttcagcttcattaatgtgtttggactggcgatcggcatggcatcggcgttactgattctgacgtatgtaacttttgagttcagttttgacaagatgcacacgaaatatccccatatttaccgtgtgcaaagtacattccgcgaaggggaggtgctgaccgataactgggcaagcagctctttcggatacggctcggcaatgaaagagaatcttgcgggaattgaagattatacccgaatcggctctctgctccaacctgaacagattgtgaagtatggtgagttgacactgcgggaaaaccagatagcttatgccgatccgggctttttccgtcttttcgatttcgagcttttgaaaggtgataaaaagaccagcctttcgatgccgggacaagtcgtaatcaccgagcgcattgcccgcaaatatttcaaagaggaagaccctatcggaaagattcttatctttaccggtccctattataagatatcgtgtgaagtgaccggagtcatggaggaaatgccttccaattcccatatacattataacttcctgatttcgtatacatctctgcccaagtttatacatgaatactggtataagcatgaagcatatacgtatgttctgctcgattcgccggagagggaagcggaaatagaaagagagtttcccgtcatggcggaaaagtacaagacggaggaagcgttgaaaaacaaaacatggggagtcgatttggttcctctggcagatatacatctcactccgcaattgggttatgaaatggagacaaaaggaaatcgttctgctatgattgcacttgtctttgcagccattgccattctggctattgcctggataaactatatcaatctgacagtagcccgttcgatggagcgtgccagggaagtcggagtgcgtcgggtagtgggtgctttccgcaagcagttgattcatcagttcctgttcgaagcgctggttatgaatctgattgcttttatattggcggtagggctgatagagctgattcttccgtactttaatcaactggtgggacgtacggtcactttctccgtttggctgatggattattggtgggtgctgctggtccttgtttttatcgcagggatattcctttccggatattatccggcattggctttgctgaaccgtaaaccgattactctgttgaaaggaaagtttttgcatagtaagtccggagaacggactcgtcaggtgttggttatcattcaatatacggcctctatgatactgctttgtggaacattgatcgtgtttgcacagctgaattttatgcgcagccaatcattaggggtgaaaaccgaccagacattagtcattaaatttcccggacgtacagacgggctgaatgtgaagctggaagcgatgaagaaagcgataatgcggttgccactggtgcatagtgtcgcagcttccggtgctgtgccgggcgaggaggtggctactttcctttccaatcgccgtaccaatgacgctttgaagcagaatcggctttatgagatgctggcctgcgatccggattatatagaggcatatggtttgcaagtgatagccggacggggcttttcagaagagtacggagacgatgtagataaactggtgattaatgagacggccgtacgcaatctgggctttgcttccaatgatgaggcgataggagagttggtaacagtagaatgtaccgatgctccgatgcagattatcggagtggtcaaagattatcatcagcaggcgttgagtaagaattatactcctattatgctgattcataaagataagatagactggttgccacaacgctatatttctatcgtaatgacttccggcaatccccgcgaactggtatcgcaggtacaggaaatatggaatcggtactttgctgattccagtttcgattattttttcctcgatcagttcttcgaccatcagtatcgtcaggatgaagtattcggggtgatgataggttctttcaccggattagcgatattcatatcctgtctgggactttgggtattggtgatgttttcctgttccacccgtacgaaagagatgggtatacgtaaagtcttgggagcttcccgctggaatcttttctatcagttggtcaaaggatttttcctgctgattctgatagcggttgtgattgctcttccggtagcctggttcagtatgaacgcctggttgagtcattatgctttccggacggatttagaagcctggttctttattgtgcccgtattgttgatgttgttcatttcattcgtgacggtggcctttcagacaatgaaaataataatgagcaaacctgctcgttcgttaagatatgaatagtttttagatcactccttcgggtattcgttaatatccggaggaattatgttaaatgttaacgagtctgctacttctattaaaccatgttataagatgctccgctttgctccggaaatttggagatatgcagaaagtccgtatctttgtagtgtgtttttcatagtattagatttaaggttaacaaaaagattggctgtctgggatagatagcctttttttatgccctttttttcgtatatttgagggacataaaaccagaatgaatattatgagaacaatcttattaattctgttactttctgttgcggcaatatcgtcatttgcccagacaaatacttatcgggaatgtacaagtcagaattttaaaataatctcatatacacgggagctttctccccaaggatgccagcaatctccgatatatgtgaagcccaagcgttcgtaatatgaagtatgactggtgcttaaatataatttcgagaatccgaatttcagtgtatccttcttggcttgttctattaaaagattggcgtaatgatttcccctatacttttcttcaatgaataaggcaactaaccaaggatataaatccgcgcgagagttaaaatcgttgctggtaagtcccgcacatcctattatttcatcaccattcattaaaaggtaccattgaggaatgggattttcggcattcagagaatgtctgaaacaattgtcatacaccattttcgtgttttcgttaccccacttgctttggaaataggcgatagctctttccagatactgaggtgagtctctgagtgaaactagattcatacgtttattgtattgtttatatttaatattgccaaagttataaaagtatttttgaaaaccaataggttgcctgttttatctgactaattctgtatatttgcaagtatgtcctgcttattaaataacatcataatatatatatggagaataaagaattgcgtgaaagaatgctttcgggaaaaatgtataatgacttgtctgtagaactggttcaaagaagagaacaggctgttttcctgaccaatgattataattccacttatggaaagcctaaagaagttcgggaggcattgttacgtaaactattgaggtgtattggcagtagtgttcattttgaaccgaatttccggtgtgagtttggattcaatatcagtattggcaataatttcctcgccaattttgattgcatcatgttggacggaaatctcattacgataggcgacaatgtattattagggccccgtgtcggtttatatacggccaatcatgcgctcgatccgcaggaacgtcttatgggcgggtgctatgcccatccgattgtcattgaagataatgtatgggtaggtgccggcgttcatataatgggtggtgtcactgtcgggagaaattcagtaatcggtgcgggcagtgtggtgacaaagagcattccggagaatgtaattgccgcaggtgttccctgtaaagttattcgggaaataaccgatgaagacaagaccggttttctgccttagtgttttacggatgaactagctcgctacttactgaaatttaaggatcgtttcacaatcctttgtcccgcaatatgcgaaagattattcgtctgacaactgttgaactttcgtctgacagttgttagacgaaaaagaaacagctgtcagacgaaagttcaacagttgtcagacgaatacttttatgtaatttcaatgctagagtttagcaaagtcgtccataagtttccttgattttgtcctaactatattccttttgtttattgctgattaccataatttgcaatctatccattccagtttgtcgaatagccataattcaaaaaagaacaagataaatgggaggataatgatgaaggtcatagtcactccactacttttcgagtgtcggtaatgattgataatagctttttttctgtctttacggtaacgaaaaaatatgaaaatgtaaggcaataaaagaatcagtacttgataaaatatgaccgcattgtctccaaagtgatgggttacactcgtgaatccaaatgccggaaaagctacgatcattatccaatactccagtaaaatgaatgcaccggagcatctgaaggctttcttgctccattgttcacccttaaaatacagataatcgaagaaataatatctgtatttgggaggatgtaatctttgttttacgcgttcgaaataattatctgttttattcgtaccttttttcatttaattgattaataggaattacatattacaacttacttgacgtatttagtaagtctctctgtttaaaaaagaattgagccatttttgagagaattctttttgctcacgagtattcggaaattcttgaatctctgcataatcaaatatcgttgcgatatctttttttaatgcaggttttccaagagtcaggatatataccttattggagacactcatcattcccgattgatgagcatttattattatggggtgtataccttatttatatcatacttttccatacatttgtttgttttggatcactgataatggctaagcggggaacgctgtaagcgttatcctgcttcgttaataacttttttctgttgtgaattattaagacgttgaactaacatcttcttgaactctgtactattacattcatttataagttctctatattcaagagattttatttctgaatacacagactctattaaatgtagtaatgtccattctatcccatataaagcagtcggtggaaagagcttgattaaaatatgtgcttcatccaaagtgacaggtttaactatcttgcctaataagtctgcatattcatcaactaatgcagccgttattcgttcatctgcttcatcgggcattgcacccattaaagctaattgttcaacttcttttctcataacaatgttgttactaatgaataaataatcacactcgacgagtagaggttatttcagtaaccgatactataaggcgaggttactgaattctattttctaattcgatatatgctactgacaaagttatgaaactattaatgaaaaacaatctagcgtccattttattttatttacatgacagacattgtgataatatgtatatattagccattcactgaaaaaatgaccttttcttaaaaagaggatatttacacaggcactaaagaccgtaattacatatcacttatcaaggagaatagaatatctccgtcatttgtaaatacgaaattctatctttatgtaattggaagtgttcttagagtaaaatggtaaccatttcctgttaatacttatcatttagatggattaattaaggaaggtactccgttctgtcattttctattttatcggtatttatgatgaactagagaaaaaacgagcaaaaacagcctttttataacttcctcactgatgaaaaacaagttcattagtaagggacggagcgttggttttaaaggaacacctcgttcctttaaaaccaaagagtactgaatgactaaaaaaagatgcatatttcatacagtattatgcaggatgaactcgtattcctgcatattattgcactaatttatgcaggatatgctgtcgttcatgactttttgagcaaattcctattggcataatattaaatttggaacatttagactgaaaggacatttatcttgtcaattccacatcttgtctacaaatgaggcgtgttcgtctcatttgaaaaaccagcaatgcagtatcccttatcttcgtgtcgaaataaaaaatagaataagtcatgaagatgaataaaactatgttgttaggggaagtagcaaaccgttcggggattccggcagatgaatgtggagtagtacttaaaacttttgaaagagtcctttgcgaagaactcacacggaaactgtaccgttatggaggatggatattgctgttgatcggtttgtttatatcagcctttgctttcgggcaaatatcggatcggaaagggcgtccggtccagaccattcgtgggatggttgttgacggagattccaaatatcctataccgtatgcgacagttagattgtcagataaagaggggatggggacgacaaccgacagtctgggacgtttcaccattccgcaggttcccgtcgggagacatacggtagaggcagcgttcatgggatatgaacccggcattttcagagaaatactggtgacttccgccaaagaagtctatttggaaatacctttgaaagaaagcgtcaacgaactaagtgaagtagtggtccgtgcgcggacgaacaaagaagaagcgatgaataagatggcaactaccggagcacgtatgctgagcgtggaggaagcgagccgttatgcaggcggattcgacgaccctgcacgtctggtttccgcttttgccggagtggcgcccagcgtctcttcgaatggaatttcgattcatggcaatgcacctcatctgttgcaatggaggctggaggatgtagaaatcccgaatccgaatcactttgcggatattgccaccttgggtggaggaatcctttcttcccttagctcacaggtacttggaaattccgatttcttcaccggagcttttccggctgaatatggaaatgcagtgtccggcgtgttcgacatgaagctgcgcaacggtaacaatcaaaagaacgaaaacacgatccaagtgggaatcatgggaattgacgttgcttccgaaggtcctttgagcaagaagcataaagcctcgtatatctttaattatcgttattctaccacaggattactgaatcttgacggtggaacgatggactatcaggacctgaacttcaaactgaactttcccacaaagatggccgggactttctcggtatggggaaccagcctgattgacaaatttaagagtgacatggagaggaaccctgagaaatgggaatatctgggcgaccgcagcgaatcacgtgacaagcagtatatggctgccggaggtatcagtcaccgttactttttcaatagtgacgcatcgctgaaaacaaccgttgccgctacctactcgcagttggacggaggcgcttccatgttcaatcatgcgttggaatcgactccttatatggaccttgaatcaaggcataccaacctgatactgaccagcaccttcaaccgtaaattcagtaaccgctttaccaataaggcaggattcacttatactgccatgttttatgacatgaaccttgccatagctccatacgaagctcagctgctggaaacggtatcgaagggagatggcaatacgagtctgatttctgcttacaatagttcttctgtcggactgagtgaccgttggactctcaatgccggtatctacggacaatacctgacgctgaataataaatggtctgtcgaaccccgtgccggactgaaatggcaggctaccccaaaagcgacctttgctttagcttacggcatatacagccggatggagaaaatggacgtctactttgtgaaaacgaagagtacgggaaatcaatccgtcaacaagaacctcgacttcaccaaggcgcaacacatcatgctgtctttcggctacaagatttcggaccgcatgaatctgaaaatagaaccttatgtacagtttctgcacgatgtaccggtaatggcggacagttcctattccgtactcaaccgctccgacttttatgtagaagatgcgcttgtcaacaaaggaagaggcaggaatatcgggattgacataaccctcgaacgcttcctggaaaaaggactttattacatgatctccggttcgttgttcgactcccgttaccgtggcggagacggtgtatggtacaacacgaagttcaaccgcaactatgtcatcaacggactgatcggcaaggagtggatgttgggacgcaacaaacagaatattcttagcatcaacctgaaactgaccttgcagggcggcgaccgctattccccgattgacatggaagcaaccatgaagcatccggacaaggaagtgcagtacgacgaaaggaaggcattctccaaacagtattcgcccatgttgatcggcaattataccgtcagctaccgcatcaacaagaaaaaagtatctcatgaatttgctgtgaagggcttgaattttatgggcacgaaagagcactacggacatgagtataacgtgaaaaccggaaagatagatgcaaccgacggctctaccgtcctgactaatgtgagttataagcttgaattttagatatccggtatagagaccataacggaaaatgttttatcttcgtacccaatgaagcatatggcaactgaaacaactgcagcaggcaacgaatcggcctttttatatagattgctcgtaagtccggcattccgatggatgcggtatctgatacttgtcatggtgttgggtactatctccttcaatcaggtcttcatcatttttatggactatcgggatatactgggcgtatggatttatgtgttcacgtttatatatatgctcacatacgttggcgttatttgtctgaaccttttctggttattcccgaaatatttgttgaaaaggcattatatgacctatctgtcggtgctgtctgtggcaatggtcattgcgctgctgatacagatggtcatagaataccttgcttactcccattggccgcagcttcatgcgcggggatcgtatttctcggttcccatgctgatggactacatttcttcttttatgctgtcaacgctttgcatgataggaggaacgatgactttgcttctgaaagaatggatgattgagaatcagcgtgtttcacagatggaaaaggcgcacgtactgtccgaagtggaacagctcaaagagcaggtcagccccgaacttcttttcaaaacgttgcatcattcgggtgaactgacattgaccgagccggaaaaggcttcgaagatgttgatgaagctgagccagttgctgcgctatcagttatatgattgcagccggcaaaaagtattgctcagcagtgaaatcgccttccttaccaactatctgacattggagcaaagctcccttccgcaattccgctatcagtttacttcggaaggggaggtaaacaggatgctggttcctcctctgctcttcattccttttgtgcagcatatcatggagttgacgcacgaacagcagatatcgattcctgtctctttggacatccatctgaaagcggagaagggtacgattgtattcacttgtatgtgtccgcaacttaatctctccgtaaacaggggactggaacggatcagacaaaggctggacttattgtatggcgaccgctacggactatcttttaccatggaatgtataagactggaactgaatggaggggaataatgagaataagtacaaacgataaaaatacgctcgacaggaatcccggtgacggaaccatgaacagcagcagtgtcaccgcttttctgctgagtcctcattgcaggatatacagacatatcctcttgcaggtggctgttctgctgattacaatcaatgttttttggtacgagcctttgcaggtggtctctctcttgaaacgctttggaggctgtctggtctatttcttgtctatgaatgcggtgatatatactaatctgtatattctggttccttcttttctgttaaagaaccgtttgggtggttatgttctagctgcgatagttaccaacttagtggtcatccttttcctttcagttacgcagggaatgctttttgaagttattttgcctgtcaggaatcccgatggatttgccactttcatcaacaccttttcggggatacttactatgggttttgtcaccgcaggttcggcggctatttcattgttcactcattggctgcgtcataatctgcgcattgatcagctggaatctaccactttgcaatcggaattgaagttccttaagagccagattaatccgcactttctgttcaatatgctgaacaacgccaatgtactgataaagcggaatccggaagaggcttctaaagttcttttcaaactggaagatttgctgcggtaccagataaatgacagttcgcgcgaaagggttgctttagcctcagatatccgttttctgaacgactatttgaatctggaaaagatacgccgggatcattttcagtttacaatggatcaggaaggggatattgactccatctggattcagccgttattgtttatcccgtttgtggagaatgcggtaaagcatagttttgatagcgagcatccttcgtctgtacatttttcttttaaggtagaagagaatcggttggagttccgttgtgaaaatacgatgccggcggttgcagtcagcaacaaggtaggagggatcgggcttgcgaatattcagcgtagattaggattgctatatcccgaccgttatgaattgaagcagatagagaatgaaaatcggtatatggtaactttatgtataacgttatgaattgtattattgtagacgatgaaccattggcacgggaggctatgaaattgctgatagaggaggcggaatgtcttcagttggtgggaagttttaacagtgccgccacggcttccgactttatggagcagcacgtagtagaccttgtctttctggatattcaaatgcccggcattacgggaattgagtttgcccgtaccatttccaaacggacattggtaatctttaccactgcctatacggagtatgcactggatagctacgaagtggacgcaattgattatctgataaagccggcggaggcggagcgctttcagaaggcggttgagaaggcgcagtcttatcattctttattattacgggaagaaaaggaagccattgagacgattgtggctgccgagtatttctttgtaaaggcggaacgcagatacttcaaggtcaacttctctgatatcctttttgtagaaggcttgaaagattatgtaattctacagttgggcgaacaacgcatcatcacccgtatgagtctgaaagcggtctttggcttgttgccgaaggactcttttttacgggtcaataaatcgtatatagtcaatacagcccatatcgattcgttcgacaataatgatatatttatcaagtcgtatgagattgctatcgggaatagttatcgggatgacttctttgaaggattcgtgatgaaacaacaaagatggtgacaggtcttgcgatgttttttatgtcatatatatccgttagtctttaatctgatgcaatattggtagataaaggaaagtttataaaagaatctgccctctgtcagtcattagaatgctgatagagggtagttgcatatcaagaaaaaatcgaaattagtttatttagcttcgttattctgtttcaaaagaaattcgtcgattgctttcttcaactggtctttgggcaaagccccttgcgtgattctcggttcttctttcatcggaatcagtaacagggtggggatactgcggataccgaaggcggcagccagttccttttcttggtccacatcaatctgatagatgtctaccttaccgctgtattctttgctcagttcttccagaacaggatgcagcgctttacacggtccgcaccatgttgcatagaaatcgacgattgccggacgtttgccttcaaatttccaatcattcggattggcttcaaaatcatatactttctttaaaaactctgctttatttaatgatactacttccattttattgtcctcctttgttggttcattactctttttattttctccgccatttcccgcacaagctgtggtggccagtacgatagcgaaagcgctcataatgcttttaatcagtttcataaatcttttcggtttatttgttttctatgttgcaaaggtaaggcgaaatagcttcccgtgaaatagcgatttgactggaacacttggcaaaatttcccatcactgctcctttaacgctaaaaaatgtctttttatctttggaagtaataaaaatatgcactacttttgtcgcgataaaatgagtattcaccctttaaaatgatggaaagggtattaattatgttggagctataatattttcaaattaggactaagttgtctcgtcgggaagacggggctttgcgacattttgttttttacgtttaccgcaactctgctgctggcggtaatagttgattagtcctgcaatcacgtttttatttttcaaattattcacttcaatgctgtggatggatgttttgtatccgtatccgaagcattggcataccgtgtataaccttactttccgctgttgaggcggacggggtgtggtatgcgaacagaaaaaaagtatgggaatacgattaaaagatttaagtaaactgggatatcgggataatgtagcccgtagtctggtagtagacattgtaggcaaatattgcaaacatgacacgaaggaacagattgcaatgactttgagcaatatactcgaacatcccgaatcttataaaaacaatgaaatatggagtaagctggcggaacgcctgtcgcctactgttcttgcgaaagagttcgtagcttacgacttacgggaagatccgttgatgtataaaacctatggaggtaagtttatcgagactcttgccaaacaacagatgaatttggctatgcgcctgcctgtaacggtcggtggagcgttgatgcccgatgcgcacgccggttatggattgcctatcggtggggtactggctactgataatgccgtgataccgtatgctgtcggggttgatatcggttgccggatgagtctgacggtatttgatgcgaaagcagacttcctgaaacgatattcttatcagataaaggaggctttgaaagactttacacatttcggaatggatggcggcctgggctttgaacaggagcatgaagtgctggatcgggaagaatttcggttgactcctttattaaaggatttgcaaggaaaggccgtgcggcaactcggaagctccggaggtgggaatcactttgtggagttcggcgaaattgctttgcaggcggataatgtgctgaatcttccggaggggagttatgttgctttgctgtctcattccggttcacgtggcttgggtgctgctattgccaaacattacagtctgttggcccgtgaagtctgcaaacttcctcgggaggcgcagcattttgcgtggctgagtctggactccgaagaagggcaggagtattggatgagtatgaatctggcaggagactatgcccgtgcctgtcacgagcgtattcacttgaatctgtctaaagcattgggactgaaacctgttgcgaatgtcaacaaccatcacaactttgcgtggaaagaggagatagctccgggacgtatggcgattgtgcatcgcaaaggggcaactcctgcacaaaagggacaggcgggtctgattcccggaagtatggctacggcaggttatctggtttgtggcaaaggggtggaagaatccttgtgctctgcttctcatggagctggaagagcgatgtcccggcaaaaagcaaaggagagtttcactcagtcggctttgaaaaagatgctgtcgcaggcagacgtgacattgataggcggaagtatcgaggaaatacctctggcatataaagacatcgaccgcgtgatgtacacacaggagactttagtggaagtgcagggtagatttatgcctcgcatcgtacgaatgaataaagaataaggcgatgaaggagaaagtctatttacagataacttccggcaggggacctgcggaatgttgccgggtggtggcattggtactcgaaagaatagtaagacaggcgcaggcaagcggactgaaagtggaaatgatagaacgtgaagtgggaccggtcaaccggacactgctttcggctaccattgctcttcaaggcgcagcgagcggagaactggcggatgaatgggagggaacggtgcaatggattgcccaaagcccgtatcgcatttatcacaagcggaaaaactggtttgtcggtgtgcattcgtttgtgttgtcggagagtcaggaggctacagaaagagatttccgctatgaaaccttacgggcttccggtccgggcgggcagcatgtcaacaagacagagtccgcggtccgtgccgttcacatcccgtccggaatgagtgtggtagcttccgaccaacgttcacaatggcagaacaagaagctggcaacggaacgcctgttggtgaaactttcgtcatggacgatggaacaggcgatgattcaggcgcaggaaaactggagtaatcataatcatcttcaacgggggaatcccgtgaaggtgattcgggaaccgctgatttagctgtgagtaataaaaaatatataaagtgactaaaaagtcggttctatctcccattcccctcccttcgggaaggaagggtggctgaaagccggggtggtaggtggatgcatagattgatgataatcaaagttatatgcttacctaccacctccccctgcggggactcctccttcccgaaggaggagagtttgaggttactaccgattttttagttcgcctttatgtatgcaggataatgtcactatatcaaggcgatagtgtcattatcctgttattattttttcgggtggttaactgaaaatataaacgataattcctgtaatcaccacatatgccagtgcatacgggatagcagctttcagtatttccccttcctttccctgctggtttccggcagaagtcgcaatggcgatactttgcggagaaataatcttaccgcctgtcgcacctaccgtatttgctgctgacagccagtccggactgacatgaatctgtcctgccacacttgcctgtaactttccgaaaaggatgttggaggaggtatcacttcctgtaataaatgtccccaggcagccgatgaccggagcaaacagcggatacaagcttccggtagcagtagccagtgccgtagcgatgacagcaatcattcccgaagtatccataatggtggataatcccacgagacagatcacggtaataaaggttttctttaattgcttcaccgtattccaaagaacgataaacagctctttgactttggcaccctgtatcaacccaccgataaaagtaccgaggaagagtagtacacctgcatgggtcaaccacgagattgtatagtttacggtagtagcattgacaggcagactgattcttgtaacccagttattctccaatgtacttctcaaactcgggaaaagcggactggtgaggatgatcaggaacaaaatcagtaaatagatgctccacgcattcagtatatctttggttttcagcgtacttttccgagccttttcttctttcgatgcggtcagttttccatagagaacgatgacaatgatagaaagaatacttccgataatggcaggcgattctgcccccatatatctggcagccagatattgtccgaccaaagaaacacctccgaccagtagggccagaaatatattcttcgggagtgctttcagtttaggattggtgaggaaaagcaagaccagcggaatcagaaacatgagtaccgataattgcaatacaacgttcgtactgagttgtagcacatccagattcgtttcctttgccaacaccaataccggagttccgatagcaccgaaagccgtagcgacactgttggctatcagactgacagtcgctgaaaatatcggcttgaatcccagactgataagaatcgccgccggaatagcaaccgccgttccgaatcctgccatcgcttccagtaatcctccgaatccccaagtcagcagcaatacctgaatacttttatccgtagagatggaagcgaactgttgtttgataatctccatcttttccgttttcagtaatacgttataactgaaaatagccatcagaatgatgattaaaataggagagaccgctttcagcgctccatataaaaaggaataaaacagattgtctacagaaaaggcgaaaccgaaaagagcgatcagcatggttacaatcaacgagataatactgctcttgtcgccggacatcttgaagaacgccatcaatacaattaatagcaataccggaataatagcaaggattagtgtcataattctaaattttaaatagtcaacttttggtgaatacttaatataacaaaacaaaaggtagttttgatggatatgtgactctaattttatccaacttctttttgtgaatgtgtcaaaaatatattcaggcacggatttcacagattaacacggttttaagagttaggtaaccccaaaccgtgaaatccgtgtaatccgtgcctgaaaaatcgttttaagtgacttccgtcccttctgctattacttgctcattttcatattcatgatctgttgcaactgtttcaagtttgcctgagcagcttcatttcctaatttggcagcttgttcaaaggctgctgtagcacgttgaatatctccgtttaagaagttatacacgcctgtattattcagaaattcggcagtggtatgatccgctttttccatatatttcagtgcggtattgatatccttctgtgacagggcgacagccgctgcattcagattggctacagcatccgttggatacatacgtacggcaatatcaaatacatctacaaagtccttgctgcctttcggataactattggctacctgatacatctcgttcagactcagatatttcggattctcacggatgatgatacgtccttgttccacatcgaagttgaccactgtgtagtcgatcttgcagttcactttacgcagtcccggataaatctctttcagcatagtgcgataaggagcaccgccgccgactttcatgatttcctgtttacgtttcacgtcattcgttgtatttttgatgatattcaggaaggtttccttatccttcatcgaagaggattcgagagctttcaccagtccgtcccagttctctccgccgaaagtcactttatacagtttggcagatgccttttcgttcttgaccagataatcttttagagcttccgcacgttttttagagagttgctcgttgaaagccagcggcccttcgggagaagcgaatccttcgatgctgatgctttgtacggtcagattcttgtcattctgaattttatcaaacatagaatgaatattcaccagttcggagtgattgttcatgaagtcggtaaggatgacagacttgttgacggggaagtccagatgagcttcgtattgctcactgcggtttttcaccacttccaccgtaggctggatgtaggctacgataggagacatggcactcagtcgtttggcttcggtagatacgtcgttcgttatcagttcctgcgcgttcatttcctgatagttgccgcatccgcataggttctctaccagttgcagggatgcgtttgccatccatggctgataaggaatgacctgcgtataattaaacgtttctcttttattataaggtacgatgatagccgtgggttcctgtttgctgatcgccagtccacgtagataggctttctcgcgtcttttgccgttgacgataatctcctgtagcgggatattatgttgtccgtccgtcagcagggggatcaggctgagactacgtgccgagccgatggttaggtttgccatgtcgaccgtcatgccgacataaagcgagtttccttgttgccataaggatacattcgaaagcgtgagcgcatcattcagaaatttctgtgcatgagccggaagtatggtggctgcaagagctataaatagatagataagttttcttttcatcattgtaagttttagaaagttcgattatttgatgacataaatgaagctgaggccgattttggtcggaccgaaatagttgcgagtgttgtgcccgagtttttcacctccgtcaccgcgggcatatttatcatatttcagacgggcgtaaccgactccgacggttgcttccatgctccagcgtttgctgataatccactggtatccgtaagagatgccggctccgtacagactgccgtcatagcggtcgtgccccattccgaatatattcaggttgctgacattcatttctccgtagtgtccgtgcaggccgaagaaacttccgttgaaacgttcgcagagccagtagcgcaattccggttgtacgagccagtgcttgatctggcagtcgttgccaaacttccacggattgtagttgccggatacatcgagggtgattttctttgccagtccgacttcgaatcccaggttgggagtgctcgtagcccagtagagggcattggtcttgatggcgaatttgggtaaataagtttcattccgttgtacttgcgcatacgcacttgtacccaatacgagcaggaaaccggctgctaataaaagtttaattgttctcatttttgttagggtctaggttttattaaaatgatatgcgataaacacatgattgtgtgactttgttgtgtaaacccgtagaaaagattccttgcccgtatccgtcataaagatgtttaagggcataaatgctaacaaattcggcaaatgatacgtttactatataaaaatacctttgtgtaatcaatatgacaactaattaatttattactgactatttttacacataacattaatacaaacagcctatgaaagagcttatcaagaatctggaagaactgaacaggaaagcagaaaaaggtggcggggatgcccgtattgagaaacagcactctgtgggcaagctgaccgcccgtgaacgcattgacttacttctggaaaaagggtcgtttatcgaacttgataaactggtgacccaccggtgtactgactttggtatggaaaaacagaaattctccggtgacggggtagtgactggttacggaatgattggcaaacggctggtctatgtttttgcacaggacttcaccgtattcggaggggctctttcggagacacacgccaagaagatttgcaaagtgatggacatggcgatgcagatgggagcgcctattatcggactcaatgattccggtggtgcgcgcattcaggaaggtgtccgttctttggcaggatatgcggagattttccttcgcaattccatggcttcgggagtcattccgcagatcagtgctatcatgggtccgtgtgccggtggtgccgtttattctcctgcactgaccgattttattctgatggtcaagaactccggctatatgtttatcaccggaccggacgtagtcaagagtgtgacacaggaagaagtaagcaaggaagatctgggtggagtgggcatccacatgacaaagtccggcgtggcgcatctatcggccgaaaatgatattgaatgtatcaattatatccgcgaacttatttcttatctgccgggcaacaatatggaagagcctcctttcgttgtcaccaacgactcgccgacccgcctgacacccgaactgtccgacttggtgcctaccaatccgaatcagccctataatataaaggagatgatagaagcggtggccgacgataataacttctttgaacttcaggcagaatttgccgcgaacatcgttaccggatatatccgtctgaacggaaagacgataggggtggtagccaatcagccgctggtgctggcaggaacactggacatcaatgcctctataaaggctgcccgtttcgttcgcttctgcgatgctttcaatatacctttgctgactctggtcgatgttccgggattccttccgggagtagatcaggaatatggcggaatcatccgtaacggcgcgaagctgctttatgcttactgcgaagctactgtgccgaaagtgaccgttatcacccgtaaggcttatggaggcgcttatgatgtgatgagttccaagcatatccgtggcgatgtcaatctggctttccccactgccgaaatcgctgtgatgggaccggacggggcagtaaatatcctgttcaagaaagagatcgaaaagtcacagactcccgaagaaaggcgaaaggaacttcagagcgattatcgtgaaaagtttgccaatccttaccgcgcagcggaattgggctatgtggatgaagtgatcgatccggccgttacccgtctgcgcctgatacgcagtttcgaaatgctggccaacaaacgtcagtccaatccgcctaagaaacactcgaacattccactttaataaatggaaagttgaaagttgaaaatggagagtgatcaattaaaagaaacagattatgataaagaaaatattagttgctaatcgtggagagatagccatgcgcatcttccgtacttgccgggtgatgaatatttcgacggtggctgtttacacgcatgtagacaggggagctttgcatgttcgctatgcggaggaggcttattgcatctccagttcgccggaggatacttcttatttgaagccggagttgatactggccattgccaaaaagaccggagccgccattcatccgggatatgggttcttgtcggagaatgccgactttgcccgtcgctgcgaagaagaaggagtgatctttatcgggcccggtgccgatattattgctaagatggggatcaagactgaggcacgcaaaatcatgcgtgaagcggggctgcccatcgttcccggaacggaaactcccgtgcaggggatcgaagaagtgaagaaggttgctaaggaagtaggttatcctattatgttgaaagcgcttgccggaggaggcggtaaggggatgcgtctggtccgttccgaagaagaagcggagacggctcttcgtctgtctcagtccgaggcgggtacttctttcggaaatgatgcggtctatatagagaaatatatcgagaatccgcaccatatcgaggtgcagattatgggagataaatatggcaatgtggttcatctgggcgagcgtgaatgttccattcagcgacgtaatcagaaggtgatcgaggagtctccgtcaccgtttgtgaaagacgaaacccgtaagaagatgctgaaagtagccgtagaggcttgcaagcggatcggttattacagtgccggcacgctggagttcatgatggataaagaccagaacttctatttccttgaaatgaatacccgtttgcaggtagaacatccggtgacggaggaatgtaccggcgtcgatctggtgcgtgacatgatcacggtggctgcgggcaatccgttgccgtataagcaggaagatataaaattcagcggagctgccatcgaatgccgtatctatgccgaagatccggagaataactttatgccatctcccggagtgatagccgttcgtgaggctcccgaaggccgtaatctccgtctggacagtgccgcctatgccggattcgaagtttccctgcactatgacccgatgattgccaagctctgctgctgggggcgtacccgcgaatccgccatctccaacatggcacgtgccttgcgtgagtataagattctgggcatcaagacgacgattcctttccatcagcgtgtgttgaagaatgccgctttcctcgaaggaaaatatgatacgactttcatcgacacccgttttgacaaggaagacttgaagcgtcggcagaataccgacccgactgttgccgtgatcgctgccgccgtcaggcattacgagagggaaaaagaagctgcatcccgtgccaccacgctccctgtagtgggcgaatctctctggaagtattatggcaagttgcagatgactgccaataattattgaataagttgagagttgaaaattgagttggttatttattaaaattagaaagatatgggtacatcgttagcgacttattatgccaagcttctggatatgccggacagtgaatataaggtagagattctggaagacggaccgatcaagaagatagcggtcaacggtaaaatatatgaggtcgattacaatatgggaggcgactccattcattcgatcatcatcgatcatcactcgcatggagtgcagatttccccttcttccaataattcttataccatcatgaataagggtgagctttatcagatagagctacagggagagatggaaaagatacacaatgcccgtgctggtacggaagccgtagggcgtcaggtagtacaggcgccgatgccgggggtgatcctgaaaatatacgtgaagaagggagacgaagtcaagcgtggagacccgctttgcgtattggtggccatgaaaatggaaaacgagattcgttctgttaccgacggagtagtgaaagaagtctttgtcgaagacggtatgaaggtcggtttgaacgaccggattatggtgattgaatgattcttgaaaaaataaaggtgttttacgtacttatctcaaaagttttctttacttttggcagataagtacgtatttatatccggatgtcttatgaacaacgaacaaacaaaagaagcactgaaagaggaattggagttgcttagaaaagaaaatgagcaactgaagcgacaacttcgatctctggaacagaataaacaacctgaagaaagctccaccagctttcaggaaaggtatgccgttaaaatcttaaattccttaccggacatgctgacggtgttcaaccacaacgaagtggggattgaagtcgtatccaatgaagaaaccaatcatgtcgggatatccaacaaagattttgaaggaatgcacatgtgccagatggtgcctcccgaagcctatcagaacatccacgccaatatgcagaaagtgatcgccacgcggactgtctcggcggcgcatcacgacatggatttcaacggctcccaccattactacgagaaccggatttttccgttggatgaagaatacgttctgatcatgtgtcgtgacatcacggaaagagtggccacccagcaacagctggagatattcaaaagcgtactcgacaaagtcagtgacagcattcttgccgtttccagtgacggaacgctggtatatgccaacaagcaatttatggaagagtacggtgtcacccaacagatgggtacccagaaaatatacgacctgcccgtctctatgcgcacaccggagttatgggaagccaaactgaaagatatacgagataatggcggaagcttttcataccgtgcagcgtatgtgcgcaaaggcgaggagaaaaacagagtacaccaagtctctacctaccttacacaggaagatgatacggagcttatctggttttttacgcaggacattaccgatgtgatcaagaagcgggatgaacttcgtgaattgaacctcctgctggacggcattctgaataatgtccccgtctatctgtatgtgaaagatcccgaagacgatttcagatatctgtattggaacaaggcatttgccgaacattccaagattcccgcctcccgggcaatcggccgcacggactttgagatctttccggagcgtgcggatgccgaaaggtttcgcagggatgatctggaattgatccggacgcatgaacggattgatatgcaggagacttacgtggcggccaccggtgagacccgtattgtgcagacactgaaagcgcttgtcccgatggaagggcgcgaaccgcttctgatcggcatctcctgggatatcactaactttcagaatatcgaacaggaactgattaaggcacgcatcaaggcagagcaatccgacagattaaaaaccgccttccttgccaatatgagccatgaaatccggacaccgctgaatgcgattgtcggtttctccaatctgttgccttctgccgaaacccttgaagaagaaaaactctattcgagcattatcaatcagaactcagagatcctgttgcagctgattaatgacatcttggacttgtcgaagatagaagccggtacattggaatacgtcagacagccgatgaatctgggtgaagtatgccggaatatctatcagattcataaggatcgtgtgcaggaaggagtgacccttattttggacaatgaagacgatgacctgattattgaagaagaccggaaccgcattgcgcaggttatcaccaacttcctcaccaatgctggtaaattcacgctttccggtgaaatccgctttggctttaaagtcgataatcaatgtatccgtttttatgtgaaggatacaggcatcggaatagctcccgacaaggtgggacatattttcgaccgttttgtcaagttgaactcgtttgcgcaggggacaggtctcggacttgccatctgccggatgatcatagagaagataggaggggagatcggagccacttcggaagtaggcaaaggatcgactttcttctttacgataccttataaagaacactcggatgaccgtattgcattttccgaggtttcggaaacgaaatacatcagccacaccatcaagagggtgcagaagatcaagaaaattctggtagctgaagatgtggacagcaactttgtactgatcaagaatatgatcggcaaagattacaccctgctatgggcgaaagatggctttgaggcggtggaaatgtataaacagttccagccggatttgattctgatggacatcaagatgcctcgtatgggtggactggaggctacccgcattattcgttcctattcgaaggagattcctgtcatagccttgactgcctatgctttcgaagcggacaaggagcaggctttggaagccggctgtaatgactttgtcacgaagccggtttcaaaagcagcattggaagaggcgttggggaagtgttcggggtagcaactacaagtgattatattatactcactttcctatctcgggaactaataagaactttgtttccggaaagtacttttcgagccaagtccgtataaactccatcgtatcatcctgaatcgttttatcctctactgtcggataaagattatagagtactgtagccagaacaatgccccgtttctgtatggcttcaagactcaggagagtatgattgatgctgcccagctttccggaagtcacgaagataagcggatatttctcctgtgcgatatagtcaattgtcaggagctccgtagtcagaggaaccatcagaccgcccgcgccttcaagcagaacacagtcataccgttcgcttaatacttcggtggcatgcttgatcttgtcgaaatcgatgggacgatgatccagtcgggaagccagatggggggaggcgggataagaaaagatctccggcatggtcagtccttcctgatcttcccaggtgaaagggatttccataatgcgccgatgcaggtctatatcttcggaatgccccacatttcctgtctggataaacttctgcgtaatggttcttttgccgtttttattccattcgcgtgccaggtagccggtcgcataacttttgccggcatcggtatcgataccgcttacaaaatatacattctgtttcatacttttttcttttttgctatgatataaatagggtgatatgtcagggacactgaagtgccctgtgtaaattcttgtgtgtaacgttcgcaaaaatgctgcaaatcacgacgggtccaagtctgtttctcgtgtttcggatagagggatgattgcgctgacaaaccattcacccccgtctgcttcagatgatacagcactttcatcggatcttcgaaagaaagggggatcagctcttcttctgagtacagtatatcaaagtgaaaagacagagctgcttcaagctcttcctttgaacgatagggcagtccctttccggtaagctcacgtatctccttcatattctttttcccaaaagtactgaaagcaaagtatccctgactgtggagcaatgtattacaccttttgaagaactcctccggcgactcgaaccattgcaaagcggaacaggaagtaatcaacgtacttttatccggaaaaggaatcgtctccgcatctccggaaagaaaagagacttgtttctctcttaataaatcttcgcagcaatacctcatctccggacataagtcattcagaagcaactcttccggacgaagggtgcggagcaacattcgggagtaaatgcccgtcccgcatccgaactcgatcactttcgggcagggagagggaatatgcttctgaagcaggcggatcattttatctgctatctgccgttgtacatttgcctcacggggataggtggagatggcttttgagaaacgttctgcaataattgtcttattcattgatcaatgattatttaatgttcatgattacctcattaaaaagctcctgctgataatgggcagcttcgacgtgcaggagggagtctgccttatttctccatgcctgctcttgatggtccggaaggaaaatccggtcgttatctccgatgatggctgtctgccagacaaactccgaagggagggatgacaggtattgctgccggatggcggcaagctcttctttcagttcttcaaccggacgtttgggagccattgtctgaaaaaccttgtaatcagcagcggaaccacacattcttcgctgaaatttcagtagggtttgttcgttcagtccttgcagggtgccttcaaaaacggatggcgtgattccttccgtttcgtgtatcggataaagtgttccgttgatggcggtactttgggaaacaggcagggagggatattgcttcattacctgcgaagccgcccagactcccatcgaccatgcgatcagcgtaatcttggaatatgcctgtatcaaagtcgtatcgaattccaacgaacgataatcgtaacaaatcatccagtcacattccgccggatggatatgtcggaaaggcgtttcgtccattccccatcctgcgaagaatagtagaaggtgcttttcattgttcctgataataaaagtctgtttcatccgttaatgatttctataagtgtatcgatttctttttctgtgatgtccgctgtcaatgagaagcggatacgggaagtcccttcgggtactgtaggcgggcgtaccggcagggcatagaatcccttgcgttgcaattcttctgccttcctgatggtatcttcgcttgctccgaccaccatcggcacgatgtggctgacggaaggacagttgtatcccttctcggttagtgcttctttcagtttccggctgatttgcagcagatgctcccttttgctccggaaatcgacgaagtgtttcagtacccatgcggtccactggatattgacaggaggaagggctgtcgtgaagataaaggtacgcatcttattgatcagatattcccggatggtctgccggcagacgatatatgcgccggcggatgctgccgccttcccgaatgttcctaccagaaagtcgatgtcgttgatgcagttttgttcttcggcacatcctaagcctttctcgccccgtgctccgaaagcgtgggcttcgtctacatagagaagaagattggagtaatcgtgtttcaatcgtaccagcgcttgcaggtcagcttcgtctccgtccatgctgaagatactctcggtaacgatgatcatcttctcatacataccgtggttttcttcaagaagacgccggagctgggctaagtcattgtgccggtaccggatacatttggcagatgataatctgattccgtctatcaggctggcatgtacgagtttgtccgcaaggatcaatgtacgggtatcactgacggcaggaagtatccctgtgttggcgtggtatccgctattgaacagaagggcactttctgctccgaacatagtggccagttgctgttccagttcctgataggcagtgaagttgcctgtcagcaggcgggaggaagaggaagtgggcagaaaggtttccggagtgatggtctttaagaacgcttctcttaaagagacttcattggctaaccccagataatcattggatgataagttcagcatccgtcgtccgtctactgtcacgtctcttccatcatgaatcaactgtgggagggaacggtaattcttcttctcttttaaagtcagaagttcttgattgatagagtctaaaatcataatctattcatttatacaataaatttaggcacggatgacacggattaggcattgtgattgcgcaaagcaaccgtgttatccgtgtaatccgtgcctaaccttttgagaagatcgttgagttacatctctctgactattttaagtactccggaagtcagtttgcttaattgctccggagagatgatgaacgggggcatcaggtagaccagttttccgaacggacgtacccagataccttcttctacgaagcggcgttgcatatatgccatgctcaccgaacgttctgtctggatgactcctatggctcctaatatccgtacatccgctacttgcggaaacttgcgggcgggagccagttcttcttttaactgagcttcgattcgtttcacattctctgcccagccggagtcgagcagtaaccggacagaagcacacgccaccgcacacgcgagcggattccccataaaggtaggaccgtgcataaaagcctttggggcatgattggagatggtatctgctatctgattgcttgccaatacggcagacagtgtcatgtatcctccggtcagcgcctttccgatgcacatgatgtccggttccactccggcgtgttcccaggcaaagagtttgccggtgcgtccgaatcctgtggctatttcgtcaaagatcaggaggatatcgtgttctttgcagagtttttccgcttcacgcagatactgcgggtgataaaaccacataccgcctgctccctgaacaatgggttcgaggatgagcgccgccagttctttagagtgtttctctatcgtttcccgcagggggatgatgtcgtccggattccattctccgtcaaatcgcgaagagggggccggaacgaaatatcggacaggaagcgatgaaccgaaaagactgtgcatcccggtaacgggatcgcatacggacatggcattccaagtgtcaccgtgataaccggaacggatggttacgaaattgtttttgtcgggctttccggctgcataccaatattgcacggccatcttcaaggcaacttctaccgccaccgaaccggaatccgcataaaatatcttttgcatggatgggggaaccaagggcaacagcagtttgcctaactcgatggccggatcatgagtcagtcctccgaacatgacatgggacatcttgtctaactggtcttttgccgcctgattcaataccggatgattgtatccgtgcacagcacaccaccaggacgacattccctcgatgagtgtccgcccgtcttcgagtgtgatcgttgctccgtccgcccgctttactttgtagacaggcaatggatcggtagtagaagtataaggatgccacaaatgctcgcggtcaaattgagagtcggcgaagtggtaaccttcttccagaatcatcttcttgtcgtcggaaaccttggaaccgagtgtggtcagcaaatcgcccacgatggcggaattgatgccgacaaacaaggctttgcgcatggcttctggagtgagctgcgaacgtcctccggcgaaacgcaggaaagcggtaggattgatgaagcggaacagggcgatggttcgcaggatttcttcttcgctcaaagccttttcattttccagtggagttccggggatcggacttagcaggttgatggggatggactgtacattcaattccgccaaagtgaaagcaaattcaatacgttgttccattgtttctcccatgccgatgatgccaccgcagcagatatccattcctacccggcgggcggcgtcgagagtggccagcttctgctcttgtgtatgtgtggagcagagtgtggggaaataggaaggagctgtttcgaggttgcagtgatagcgggtgattccggctgtgtgcagggcgcggagttcttcttcattgagtaatccaagggatgcacaaagttggatggacgaatgtttccgcataaggcgggctgcatcgcaaagttgactgatctgtttgggagaaggttttcgtccgctggtgacaagggagaaacggttgacgtcttgactttcgttgtattttgcctgtcggagacattcttcagcgggcaggagatcgtaaatctcggcttgagtcttgtagtgagaggattgtgcacaccatttgcagttctccggacaccggccggacttggcgttgatgatggaacacatatcgaactcgtgcgaagcacaagtgacggtaatctcatgcgcggcggcataaagcgcctcgctgtcggccatgttggccagccaagtggcttgggcggacgatatgtcgaagcctgccagtacttggtctttgatttcttgaagtgtcataaatgtatgatatgggatagtaacttttgcattctgcttgcgaagagccacatctaccacattggtatgcagatgaccgatctgaaattcacgtcccatactcgcaaaagcggcatagttcttcctgccccagtagcggaagcgggaaagaagggaacgggtggtctgtatgtggcgctgtttcttcatcaggttcttgttttttgaagttaagaacggggcaaatgtacaaagattctttggataagcaagcgatacaataatatactgcaaatatatactcttaccttgtatcgtttatacacaccctttatcttgtattctttcttctatattccttgcgtaaattgaaattgaatccgacgtatatctgaagtgttccgaacccgttgtccagtgaaaaattattccggtggtaattatagttctttccgacaaatgaagtgccgacgaaatattttccgttattgtagacaactcccgcacggatcagaaaatccaggttaaaattgccgtaccatgtcttcccttcatgggtttctgcatctacatcggaggctttgtaggctatggcgggagtgagagacaggcatgccagacagttgcgggcaaatacccagttataggcataaccgaaactgatattggcattggtgtatttgatgttgttgactttcatggcaggattcatcgcttccagtatgaaatccggaagttccgcatagtcgaattcaagattatgttttgaaatagaaaagcctgcgataaacgaacctgcattcctgcgctgattggttgactggctgaaagcggcagggtaggagaatttgcggttgttgaagatatagtataggttcagtcccttgatatctacttttatcccattgaacttttcggagtaattggcggggacatcttccgggaaaccgttgatcttatgaatcttatagttgttacctgtgcgacgatagaagatgtccactcccagcttggaactgtatagacttaaatcgaactcggttcccttgttccttcggttggtcttccggtaaatgtcgtccacgtctacagaccatcccaggaagatccatcgccagccgaagtataatcctatcttgttatgcggattgggagagaaactcagcttctgcggttggggcagattgctggtaacggaataatattcaaagttgctgaaatgggtggtcatcaatgcgtaattataccggttgtgactgatataaagggtgtcgaagtcactgaaattcatgaacttcctgatcgctctcttgaaagcgcttggtttggccggtatcacagaatcagtttgcagactatcgctcataagggtatctctcctttcagtttgggcctgtaaggagagtgacagaaacagaaaaagagatagaacaatttgcttcatcctgtgatttttcgttgctatgattgatgctgttcgtttcacgaatgtactacctttcgttgatttatactaataatcgtctaaaaaaatgtttcgtttcctaaacaaatgagatatgtattctgttagttagaacaagcaaataaatcctaagccacaaaattatgagaatctatttacgtttattagtggcgtttctattgctttctgccggcaatgtagtgtatgcagaagcacaacaagagaaacgcgtaacgggtactgtgacttctgaaggagagcctttacccggtgtttccgtacaagtgaaaggggcctcctccggcaccattaccgatatcgatggaaactattcaattgaagcccctgccaatgggactatcgttttccgctttgtaggattgcggacagtggaacaagcggtgaacaaccggaatgtgatcaatgtcaccatggaatcggagagcaaagaactggaagaagtgatggttgtagcttatgctaccgccaaaaaatatagttttaccggagctgcctcgacaatgaaggcgggagagattgagaagttacagacttccagcgtctcccgtgtacttgaaggtacggtatccggtgtgcaagccagtgcttccagcggtcagcccggtacggatgccgaaatccgtattcgtggtatcggttcgatcaatgcttccagtgccccgttgtatgtggtagatggcgtaccttttgatggcagcgtcaactcgatcaatcctgatgacatcgcttccatgactgtgctgaaagatgctgcatctgcagctctgtacggttcgcgtggtgcgaacggtgtgattatcattaccacaaagcagggacagcaggactcgaaagctactgtcaaggtgaaagctacactgggtggttccagtcgtgcggtacgtgattatgaccgcgtcaataccaatcagtatttcgaactttactgggaagcgcttcgcaaccagtatgccaagagctccgattatacccctgccaccgcagctgctcaggcttccaaagacttggttacaaaattgatgggaggcggtccgaatccttacggtacacaatatccgcaacctgtggggacagacggaaagctggcagcaggtgctcgtccgttatggaactccgactggagtgacgcgatggagcagcaagcgcttcgtaccgaactgaatctgagtgtttccggtggtggaagggctaatcaatacttcttttctgccggctacttgaacgataaaggtattgcactcgaatccggctaccaacgtttcaaccttcgttcgaacgtgaccagtgaaatgacttcctggctgaaaggaagcatcaacctgagtttcgcccattccatgcagaattatccggtttcttcggattccaaaacaagcaacgtgattactgcaggacgtactatgcccggattttatcctatttatgaaatgaatacggacggcagctacaagctggatgacaatggggatcgtatctacgatttcggttcataccgtccttccggttctatggctaactggaacttgccggctaccttgcctttggataaatcggaacggatgaaagatgaattttccggtcgtacttatctcgaagctacgatcatcgaagggctgaaattcaagacaagtttcaacttcgacctgatcaactataatacgctggattatacgaacccgaaaatcggtccggctctggaaaacggaggtggttccagccgcttgaactcacgtactttttcatggacatggaacaatatcgcgtcgtatgataaaaccatcggtgatcatcactttaatgtgcttgccggaatggaagcctattcgtaccgctatgatgaactgactgcttcacgtacgaagatggcacagcctgatatgcccgaactggtagtcggctcacagttgacaggcggttccggttatcgtatcgattatgctttggtgggatatctaacccaggcgctttatgactatcagaataaatactttttctccgcttcctttcgtcgtgacggttcttcccgttttgcaccggagactcgctggggtaacttctggtctttgggaacttcatggcgtatcgaccgtgaaagttttatggcttccactgccaactggctttctgctctgacattaaagatgagctacggtgcacagggaaatgataatctgggtacttattatgcaagcaagggactttatgccattgtttccaatctcggagagaatgccttggtttccgaccgtatggctactccgaacctgaaatgggagacgaacctaaactttaacgtcggcgttgatttctcactgtttaacaaccgtttttccggttcgttcgacttctttacgcgtcgttccaaagacttactttattcccgtccgatcgctccttccttaggatatgggtctattgatgagaatgtaggtgcactgaagaatacaggtattgagatggtgctgaacggaaccattatcaatcagaatggatgggtatggaaactcggaatgaacctgacacattataagaataaggtaacggaacttccgctgaaggatatgccgcaaagtggcgtgaataaattgcaggtagggcggtcagtctatgacttctatatgaaagaatgggcgggagtagaccctgacaacggtaatccactgtggtatatggatgagaaagatgccaatgataatttgaccggaaaacgtgtcacaacaagcgattatgcttcggcaagttattattacgtcaataaatcttccctcccgaaagtttatggcggttttaatacatcgctttcatggaaagggttcgatctgtccgccatctttgcttatagtatcggaggatatatctacaatcgtgatattaccatgattttgcacaacggaagtttggaaggccgtgactggtctacggaaatattgaagagatggacaccggaaaaccgttatacagacgtgccggctttgagcactacttccaataactggaactcagcttccacccgtttcttgcagaacaattcatatatgagactgaaaaacctgacgctatcttacgatctgccgaaacagtggatcagcaaactggcattgagcagtgtccaggtgtttgtgcagggagataacctgtttactattcaccggaatcagggacttgaccctgaacagggaatcacgggtatcacttattaccgttatccggctatgcgaactatttccggaggtatcaatctatctttctaaaattacacgatatatgaaaaagataaaaattcaatctatacttactgctgttgccggactgtttctggcaacgagttgtagcagtagctttctggatacggaaccgacggatgcggtaagctccgatcaggtagcagtagctggaaatgcagaacgtctcttcaacggagcttggtataacctgtttgaatacggaacgacgtatgccaatattggttatcgggcacttcaatgtcaggatgatatgatggcgagcgatgttgtctcccgtccgaaatatgggttcaattcttcctatcagttcaatgacgtggcgatttcttccgatggaagaacttcgtttgcctggtatctgatctataagacaattgataattgcaacactgccatttcgattaaaggtgactccgaggaacttcggcaggcacagggacaggcattggctttgcgtgccttttgctatctacatttggtacagcattatcagtttacatatttgaaagataaagatgctccttgtgtgcctatatatacggaaccgactacaagcagtaccgagccgaaaggcaaatcgacagtggcgcaagtttatcagcagatctttgatgatttgaatcttgcacaggattatctgataaattacgtccgcaagggagacgggcagaaattcaaaccgaatacggatgttgtcaacggtcttctggcacgtgcttacttattgacaggacaatggggagaagccgccaaagctgccgaagctgcacgcaaaggatattcattaatgactaccactgccgaatacgaaggttttaataatatttccaataaagaatggatttggggatctcctcaaacactctcgcaatcggatgcaagttataatttctactatctggatgcaacatatgtcggagcttacagtagctttatggtcgatccgcacttgatggatacttttgctaaagatgacatccgtctgcctcttttccaatggatgcgtgaaggatatctgggttataagaaattccatatgcgttcggatgatactgcagatctggtactgatgcgttcggcagaaatgtatctgatagaagcggaagctaaggccagggatggagtagcactggatcaggctgttgccccattgaatacattacgtactgcccgtggcgcaggtaattacgatgtgacagggaaaacgaaagagcaagtgatcgacgaaattctgatggaacgccggcgcgagctgtggggagaaggattcggtataacggatatactccgtaatcagaaggcggtagaacgtatggctctatctgaggatatgcagaaaacggaagtggattgctggcaggaaggcggcagttttgcgaaaagaaatccgttaggacattggttccttaatttcccggatggtaaagcgttctcagcaaacagttcttattatctgtatgctatccctgaaaaagagattaatgcaaaccctaacttataaataaatagctctcttaattttttgactttgaccttaacttgtagaccggtatacgtcgtgacgatgcataccggtcgtttttttatacctgtatcttctgtttctttaaattgggtaaaaagaacgtgactaatcccaataacggcatataagcgcaaacgttataaaccgactcaattccaaatttatcagccatattgccaagtacagccgaagcgatacctgctactccgaaggcaaaaccaaagaaaagaccggaaatcaatcctagcttggtagggagtagctcttgcgcataaagcaggatagccggaaaagcagacgaaagcattagtcctacacaaaaacttaagatgatggtccatgctaaagtggcatgcggcatcagtaaactaaaaggtgcagcccctaaaatagaagcccaaatcacatatttacgtcctacacggtcaccgataggaccaccgagtaatgttccgatagcagtagctaccagaaaaataaataagtataattgagattcctgtacagttacattgaatttatgaatcaaatagaatgtataataactggtaaggcttgccatatagatatactttgagaagattaatatcagtaggattccgatagataaagcagtcttatccatcggtaaaggcaaatgtacagcctttttcactgtagccttttgctctttcattcggttgagataagatttgtaccatttgcagatcggagacatgactccgatagcagccaaagcaaaaagtgtaaaaacggctagatgctctctgccataaggagccaccagcaaagccaccaataaaggacctagtgaacctcctaaattgcctcctacctgaaataacgattgtgccagtccccgttttccacccgaggcaagaaaagtgatacgtgatgcctccggatgcaagacggaagaaccgattccgatcagaaaaacagagaccagcatccagtaaagattgttggagaatgccagattgatcattcctatcattgtaaagctcattccgataggtagtgaccaggcaacgggatgtttatcgaagatgattccggtgattggctggaataccgaagccgagagttgataaaccagtgtgataaggccgatctgtgcaaagttgagtcccaaatcgtctttgaataatggataggctgccgatataacggactgcaaaagatcattgagacaatgcgaaaggcttagtgcgatgaggatagaaaatgtaattcttcctacgggttgttcctgattctgtaccataatacctattcttttgaaatgttcctgaaaaaatgactgcaaaggtacgtaaacttcccgtttctcaatatatttgtcacaattaaatctataagtaatgaagaaagtagtattagcgatggattctttcaaagggtgtctttcctcatcagaggcggaaaaggcggcggaagaaggcataaagctggtttgtccggattgtgaagtcattcgttttccgatagccgacggaggtgagggaatattgactgtcttggtagaagcaacacgaggcacttatcagaagatcatagcgaatgatcctttgatgcgtccgatagaaaccacttatggagtttcgggcgacaaatgcattgcttttattgagatggccaccgtgaatggtctgccgctattatcagaaacggaacgaaatccgatgctgaccactacttatggaaccggtgaattgatattgcacgctattgaacagggatatcgggaatttgtcataggtatcggaggaagtgctacgaatgatgccggagtaggtctgttacaagcattaggagcccgatttctcgataaggatggagcagtcttgggaaaaggaggcgaaattctgcatcgaattgccgctattgatttttcttccgttcatcctgcacttaaagatactcgtttcacgatagcctgtgatgtgcgcaatcccttttgtggcccggaaggtgctgcgcatgtttttgcccgacagaagggggcggatgatacaatgatagagaaattagatgtgggtatgcagtctttttcccggttgatccattcaactaccggaagagaaattactcacgttcccggagcaggagctgccggaggcttgggaggtgcctttcttgcttttctgaatgctgaactaaagcccggcattgatttactgctccaaacattgaaatttagtgagaaaataaaaggtgctgatctgatcataaccggtgaggggagaacagaccgtcaatctttaatgggaaaagtaccctccggaatattagaagaggcgaaacgacaagggataccggtcattgttgtggcaggcagtatagaggatacggaaattctgaatcaggcaggttttcaaggtgtcttttctatcattccttcgcccatgtctttggaaacagccatgaagccggaagttgctaagaaaaacatttgccggactgttgcccaaattatctctttagtgaatttataatggcgtttgtagtgtaaattgtcgttaattcatttttgacttactgaactattcgtggtacctgatgttgttaaataaaaaaggaggataaaatgggctttatttggtatattattattggtattatagccggctttcttgcaggtaagataatgcgtggcggaggttttggccttattataaatttgttacttggtattctcggaggagtgctgggcggttgggtatttgcccttttcggacttgcggcttcgggattgattggaagtttgataacttctaccgtaggagctattctggtattatggattgcttctttattctcgaaatctaaataaagattttatataatttatttttaatctaaaaacagaacttaattatggaatgtagacatggaaatttctggattggacttggaattggttcaatccttggtgcagtagcttatcgtctttcacgtacagcaaaagccagacagttggagagtgatatttataacgctattcaccgtatcggtcgtgatgctgaaatagcagcagccgaagctgaaagaaaagcaatgaatcttggcttaaaagctgttgaaacaggagctaaggtcgcagataaagtagctgaagaggctgataaagcagttggaaaagcaaaagaaaaatgggagaaataatcatccttgaaagtggtaatcaggtttaaaataactggttatcacttttcttttgtacttatagcttccttcttgaaaatctaccttaaccggatactgtcactatccttcatatctgcttttgcatagaataatcagtgtgtgtccgtacacattttaccttttacatcccttttttttgttcttttcacagataaaaagcttttctgtcatggtgtttattacctcccaaacgaatatttgatggctttttccactctttttcttatgtttaacaacatacgtattacttgtctttctttgttaaatatctgaatatcatatttatagcatttctataatagaatgtgtgtgcgcacacacttttgcttaattcaataattcattttacatttgtcgtcgaaaaacaagatacttatcagtatatggacaaagaattctcaaatattcgtattgtagacatcgccaagatggcgggagtctctgtcggtacggtagaccgggtgattcataatcgtggacgggtatctgaagagaacaggaagaaagtccagactattctggagatggttcattatcagccgaatctgatggctcgttcgttggcatctaaaaaacaatatcattttgtggcaattactccttcttttacgcacggagaatattgggaagctatttctgagggtatcgataaggcggcttcagagatggaatcttataatataacgatcactaaactctttttcgatcaatacaataacaagacatttgatgatattgtccgcaacctgttggatgaaaaagtagatggggtattgattgcaacactgtttaccgactctgttatacggctttcgcaagagcttgacaggaatgaaattccctatgtttatgttgactccaatattgaagggcaacatcagttggcatatttcggaacggagtcttatgatgccggagtgattgctgcgcgattattgacagacaagatttcttcgacttcggatattctgatggcacgaattattcatagtggaaaaaacgactcaaatcaaggaaagaaccggagagaaggcttttgtcattatctgaaagaaacaggatttaccggaaatttgcatgaagtagaattgaaaatcaatgattcggtttacaattttatcaagctggacgaaatctttgaagcgaatgcaactatagaaggaggcatcatctttaattcaacttgctacatcttaggaaactacctgaaagcaagaggaatgcaaaaagtaaaattggttggctacgatcttattgaaaggaatactcaactgctctccgatggcgttatcactgcattagtagcacagcgtcccgaacgacaaggatatgatggtatcaaatcattgtgcaatcatttgctgttcaagcagaaccccgaaaaggtgaacctgatgccgattgatattcttctaaaagaaaatctgaaatattatctgaacaataagttataaaccatataaataaaagaaccatgaatgaattatttaacgtaaaggacaaagttgttgttatcaccggtggagccggaatcttaggtaagggtatcgctgcatacttagctaaagaaggagctaaagttgttgtactcgatagaagcgaagaagcaggtaaggcattggtagaaagtatcaaagctgaaggaaatgaagctatgttcctgtatacggacgtaatggacaaagaagtgctggaaggtaacaaagtggagatcatgaaagcctatggccgtattgacgtattgctgaacgctgctggaggtaacatggcgggcgcaacaattgctccggacaaaactttctttgacttgcagattgacgcctttaagaaagtggtggatttgaatctgtttggtacggtattgcctacaatggtatttgctgaaatcatggtagaacagaagaaaggttctatcgtaaacttctgttccgaatcggctcttcgtccgttgacacgtgtggttggttacggagctgcaaaagctgctattgctaacttcactaaatatatggctggcgaactggctttgaaattcggtaacggtctgcgtgtcaatgctatcgctccgggattcttcctgactgaccagaaccgtgcgctgttgacaaatcctgatggttctctgactgaccgttccaagacaattcttgctcatactccgttcaatcgtttcggtgaaccggaagatctttacggaactattcattatctgatcagtgatgcttctaacttcgtaacaggtacagtagctgttatcgacggaggttttgacgcattctccatttaatacctattacttattacttaatacttatcatattatgtatctatgtgaacaaacttggcgctggtatggtccgaatgacccagtaagcttgtgggatattaaacaggcaggcgctaccggtatagtaaacgcacttcatcacattccgaacggcgaagtgtggacagtagaagaaatcatgaagcgtaagcaaatgattgaagaagtgggcctgacttggtctgttgtggaaagtgtacctgtgcacgaacatatcaaaacgcagaccggtgatttcttgaaatatattgaaaactataaggaaagcatccgtaatctggccaaatgtggtgtaatggtagttacctataacttcatgcctgtattggactggacacgtacggaccttgcttatacaatgcctgacggctctaaagctcttcgctttgagagggcggccttccttgctttcgacctctttattctgaaacgtccgaatgcggagaaagactatactccggaagaaatagccaaagcaaaagcccgtttcgaacaaatgagtgaagacgataagaaattgttggttcgtaatatgattgccggacttccgggatcggaagaaagtttcaccgtagaacagtttcaggaagcattggatcgttataatgatatcgatgctgagaaacttcgttctaacttgatcttcttcctgaaagaaattgcgcctgtggctgatgaggtgggagtgaagctggtgattcatccggacgaccctccttatacaattttaggtttaccgcgtattctaagtacggaagaagactttaaaaaactgattgaagccgttcctaacgaatcaaacggtctttgcttgtgtacaggttctttcggtgtacgtgctgacaatgaccttgcaggtatgatggagcgttttggcgatcgtgtcaactttgtacacttgcgtagtacacagcgtgacgaagaaggaaacttctatgaagctaaccacctggagggaaatgtagatatgtacaacgtaatgaagagcctgattcttctgcaacaacgtcgtaaatgttctatcgctatgcgtccggaccatggtcatcagatgattgatgatctgaagaagaaaacaaatccaggatattcctgcttaggccgtcttcgtggattggcagaacttcgcggtttggaaatgggtattgcaaagtctattctataagcagaattcataattagcaatctattttaaagacactacggctattattgacagtaataatagtggtagtgtcttttatattgctcatttacggagctttcgtattaaaataagcttccggtgtgcaaatcaacttttggctttttaggctcggggatgatgagcaaggctatttgtgcacaagcctcagcatcggcgagagcatggtgatgattggttaaatcatatccgcatcgggctgccaccgtatgtagctgatgattgggcaactcttttccaaacactttccgtgaagtgcggcaagtacaataaaacttataattgggataagtcatttcgtatagctcgtgaacagttttcagacagccctcatcaaaaggactgttgtgagcaacaagcggaagaccgtctataagcggttttatttctgcccatacatcaggaaaatcttccgcttcttccgtatccgcgtaagtcagtccgtgaactgctgttgtccattgcgtataatagttggggcaaggacggatcagacgatagattttcttaacgatttttccgttcctcacgatgacaacccctacgctgcatacgctggtgcgctttccgttggctgtttcaaagtcgatagctgcaaagtccttcatgcgttttgctgttttttgaaacacaaatgtacatgatattttttgcaaaatacatgaattggcatttattctctttatatttgcgtataaaatagaccgatgtacacagaatatcagccctctcgtctactcgctccctatattgataattattgggaatttaagggaactccggaatatggtatgcgtatccatattttgccggatggttgtaccgatttcatttttacgttgggagaagcagtgagtaaggtaaaagaagaaacgctggtcatgcagccttatcgttcttactttgtgggtccgatgacgaaatattcggagcttgtcacttatgccgaattcgttcatcagttcggcgttcgttttctgccttgtgggttatccggatttacaaagctgcctttgcatgagtttgcgaattacagaatcagtacgaatgaaatgcaggcggtttttgacagtacctttatcgagagggtatgtgagcagaatgatgtccggggacggattcaggtcgttgaagaatatctcctggcgtatcttgcacataactatcagcctgttgattcccaagttgccgcagcggtgaatataatcaatcagtccggtgggaagcgttctgttcgtagtctgatggatgaggtatgcctgtgccagcgtcattttgaacggaagtttaaacataacaccggattcactcctaaagaatatagccgcattgttaaattcaagaatgcagtagaattactgagaaacacggcctctgtcaacctgctgactaccgccatcgacgcaggatattatgacctggcacatttctcaaaagaaatcaaaacattgtcgggcaatactcctacatcatttctttcgctcacagttccggaggatataacgctgacttatatcgaaccttagaaccggattagtaaaagtcgattttttacaatagaacggacatctgtgccgttatctttgtggcgaaataaaataaatacaataagattatgtcaacaaaaactatgaaagagaaagcggcggagttattgcagaaatgcgaagttgtcacccttgcttctgtgaacaaggaaggctatccccgtcctgtgccaatgagtaaaattgcagcagaagaaatttccactatctggatgtccaccggagcggattcattaaagactattgattttttatcgaatccgaaagcaggattatgttttcaggagaagggggacagtgtggcattgatgggagaagtggaagtcgtgacagacgagaaactgaagcaggaactttggcaggactggtttatcgaacactttcccggtggtcctacagatccgggctatgtattgctaaagttcaccgccaatcacgcaacctactggattgaaggtacctttattcataaaaagcttgactaatcttgatctggagcgattataaaattgacaggtaacggtacatttgtgtacgaaaaaagagaaagacattcccaaagtaaggactgtttttctcttttatgtttaggctggaagacgtggttttcgtctatctgacattcatttagaattcaaacttttccagtttcatttcagctaattcctgaatgatacctacgtattgtgcaaaatgagcggttttctcgtgtgctgccaatacttcagcattctgccatgtttcgcaaatcatgaaaacatcacggcgggtactgctttcaaaagtatcataagcaatgcatccttcttctttcaaagagcaggcagtcagttcttttgctgccttaatcgctttttcgcggtttgtttcgtttacacgaacaaaaacatttaatctgatcatagttcttttattatttatgtgattaaaaagaatggtttcatcactgtgtttgtgaagaaccgaaggcaaagatagtatttttctgtagcttcccgcaggctgttttcaaattttcatataaacttcatataatcataaaaaatcggttatatttgcatctgaattctaaaagcaactattttgggcaccattcttaaatttgttatagcttaatattagcctcataaaccacaggctaatttctttcgtttgagtacttctacttgaaccggtttttcattttatcaattttattattcactgcatcgttttttaaagacgagtgcaatttggtattcaggcttttagtcagactccttatgatgattcgaaagctgcgggtacattgagaatgaatggaaaatttcgtaagaaatagtaagctgaacatagaaaaagaaattaaaaggattgagcaacagccgattgcccctctcgagcggataaagcagataatagatgtcatacagacatcacttactttgctgaaaagggcagttgccgaatatcaatttcagaaccctgaagaagaaattcagttctttaaagtctggaaaccgcagatttccggcttgctgatgttttatatccgtttatatcagattgaaaagaaccgtgtcggcaaatccctgtcggctcaatgcaaatatttaaagatggaactggagaatatacagaagtcatttttgaataatagcttctatgattattatcgtgccggtcagaccgaacttgataaccactattttatccgtgagaattatgatattctttccgatgttcattgtcatttgctggacagggatccttcttttaccaccttacacgattcaagcgttgcaatgattctggcgaatagtcatttgatagaatatgtatcagacgagatcgattcgctgtcagacaaactgcatcttaaattcacctccatagtagacagtaaattgctgcaatggacagatagtaaagttgccttggttgaattcatctatgcgatctatgcgggcaaatgctttaataatggaaataccagtctgaaagacatcgctttttgttgcgaggtacttttcaatatcgagattggagacttttatcgtatcttcttggaaatcaggaatcggaagaagaacaggacacaatttcttgataagttgaaggataaaatacagaagatgatggatgaactcgacagataaatttcacgccatcttgtgacatcttgtgaattttataaatggcttatatccaactttgctttatggatacaacatttacatgggagataaaagcaaagaattctcctttattaattaagaaatgcagtcattgcgatagtgaccggttttactgtagtgataagtttagaatgaatgcgcagaaaaagaacatcgatgtctggctgatatatcggtgtgtgaaatgcgataatacttgcaacattactttgctgtcacgtaccaaaccggatttgatagataaagtcctgtttcatagcttttccatgaacgatcggaaagcagcctggaaatatgctttttctgccgaacttgccggcaggaatcatttgaaaacggattatgatagtgtagaatatgaggttatggataacttctcgaaagaagatataatccgtatgtccgatgcaatcataaagattcaaatcaaatgcgagtttgaatttaatttgaaattgtcgtctttattaagaaggaattttcttctttccagcactcagttaaggcgtctgtttgaacagggagtgatttcgcttctttccggtaaagagccgcagaaatacaaagtaaaggacggagatatcctgttgatagataaagaacatttgcttgttatgatggactttgtggatagctttatggtaaaaacaggcattgattgattttttattactacatttgtctgatatggaacagggaattcagaaactaagtactattataaattcagagatatgagaaaattgttcttattagctattgttttatgtgtatggagtgtcgttgccgatgctcaggagagtgagggaagatatattgaggtaaccggttcttctgaaatagaagttgttccggatgagattcatcttttgattcaaataaaggaatattggaaagaggaatttgtgccgaagtccaagccggaagattataaaacgaaagttccgttggaatggattgaaaaagatttgcgtcgggtgctaagtagagcaggaatttcggatgaggctattcgtgtacaggaaatcggagactattggcgtcagaaaggaaaagaatttctgataggtaagcaactggacatccggtttactgacttcgaaaagataaatgccgttattaagaagattgatacgaaaggtatcgagtccatgcgtatcggggagctgaagcacaaggatttgccgaactatcggaaacaaggtaagatagaagcattgaaagcagcacgtgaaaaggcatcttatcttgtggaagctatgggacaaaaactgggtgaggtcattcgtattgtcgaaccggcttcgagctatgtaagtccttattctctttatcaggcacagagtaatgtcagtatggggacagctgccactgagcaatatcgcgttattaaattgcggtatgagatgacggcgcgttttgccattgagtaatatggataaggcgaaaatgtgtacaaaggtattgactacgcaaactggtaggaatgctccattagtaagttgctgttgggagattaagttcttagtatgggttatctttttcttgctaagaattaaagttcgcattacataaaactgtacctttgtatgcgatagactattcgtctgactatagtgatacttgcgtctgactgtagttgctctttcgtctaactatagtcagacgaaaagagaactatagtcagacgaataattatatgcaggctaagcattaaagaatagtatatacagggccaaatattaggaaagcaagcaataaatatataaactgataaaacaaagctagtaatgagtacatattatgatttatacgaaacgccagatgttcagaatacaggagagaaacaaccccttcatgcccgcatcgttccgagtggaacttattcgaaaaaagattttatagaacgcgtatcccgtcaccaacctttcccgcacaatataattgaaggagtacttggcgctgtagttgatgaactggccgaagccttggcggatggatacatcgtggaactgggcgaacttggacatttcagcatttcgttgaagtgtacccataaagtgatgactaagaaagaaattcgtgccgagtctatccgttttgacaatgttcatttacgtacttccaaagaatttaaaaagaaaataaagcgggagatagaacttgaacgagttgagaactccaaagtaaaaactcacgatactaaaatatccattgaagaccgtctccaaatgttgcaggaatttctgaagaagaacggaggaatcacgcgtatagaatatagcagactgaccggactcccccgattgaaagcaattgatgatttgaatgctttcatcaaggagggaactcttcgcaagaggggagcaggaagaactgtcttttatgtgtggaaacaggaagaatgatattataacagaaaaccatctttctttttgctaacaattttgtatctttgtgtgtatatagataaaatagtgagattatggcaaaaataacaataccttatgcagtagctgatttcatagaaatgcgtgaacgtgggttctattatgtggataagacagactatatttcgaaattagaggaatataaggctcctgtgttttttcgtccccgccgttttggcaagagtttgttggtttctactttagcttgctattatgatcgtaccaaagcacatcggtttgaagaactgtttggaggtacttggattggtagtcatccaacgaaagaacataatcaatatatgattattcgctatgatttttcaaaaatggtgatggcgaatagtatagagggattggcgcagaacttcaatgatttaaactgcggtccggtagatcttatggtcgaacataacagagatttattcggtgattttcagtttaccactcgtggagatgcttccaaaatgctggaagaggtgctcaattatgcccgttcccatggctttcctaaagtttatatattgattgacgaatacgataactttaccaaccaattacttacagcatataatgacccgctttatgaggaagtgacaaccaatgatagtttcttgcgtactttctttaaagtaataaaggctggtatcggtgaaggcagcattcgtacttgtttttgtacgggggtgttacctgttacgatggatgatttgactagcggatacaatatagcagagatacttactttggaaccgggttttatgaatatgctcggatttacgtatgaagaaacagaagtttatttgcgctacgtgcttgataagtattctacaggacaggaccgctataatgaaatttggcaactgattgtgagtaattatgacggataccgtttccgccctaatggagaccggttattcaatgctaccattcttacttattttttcaagaaatttgcagccaatgcgggtagtattcctgatgaactggtggatgaaaatttgcgaacggatattaattggattcgtcggcttactctttcattagataatgcgaaggcaatgctcgatgcattggttattgatgacgaattgtcttataatgtagctgatctttccagtaagttcaataagaagaagttttttgataaggaattttatcctattagtttgttctatttgggaatgacaacgttgaaaaatagttatcgtatggtactacctaatctgactatgcgtagtgtctatatggattattataaccaattaaaccggattgaaggaaatgcacaacgctatgtgcctacttatgaacgttatgatgccgaccgccgtttggaacccctagtacaaaactactttgaacaatatttgggacaattccctgcacaggtatttgataagatgaatgaaaattttattcgctgttctttttatgaactggtgtcgcgttacttaagcagctgttatacatttgctatagagcagaataattcggtaggacgttcggattttgaaatgacaggtattcccggtacagattattacacagacgaccgtgtggttgagtttaagtattatcgtgcaaaagaggctgaaaaaatgctgacacttactgaaccgcttgcggaacatatagtgcaggtcaagaaatacggagaagatacaaaaagaaaattccctaactatcatgtacggacttatgtggtatatatttgtgcaaacaaaggatggaagtgttgggaagtatagattcctcaaggactacacttcacgataaaataaagtaatggaagaactctttcgattggtacgagatgaaaacgacattgataaagccttgtctatgatttgttcgggctacatactggaaccgtcttataagagcgaatacaattgcagtcttttgtttcatgccgtttatcggaaaagcctggtattggtaaaaacactggtagaacaaggcgcaatcaagcagtatcttttcgaattgccatgaattattatataaaatcatattgaattagacaatccttaataaattattgtagttatgtcaatgcatgcaatagagagtttggtggaatattccgtaataaccgtagcgactgctttgcctgttccgcctttggcacaaagtatttgccatagtctttatcatcttcagaaccaattagactgtgggtacacggtcttgcgggttcgcgacgaattggaaaaggtcggttatctttccctactctcaccagagcaactgcccgaaccggagcgtagtgaggcaatggagcttgccgcagagggcggtttcttgaaaggtggtggcatttatgtggatcgtcgttccgggaaatgctgtgtcaccgcaggatgcgtattatggaaaaagctccttgatatgagtgttattccggcatcgcccgaagcggaactccgtctgctcgatcctttggaattggctgaacagattgtttcattggcttccaaggctcttgccggaggtgacaaacggggagccgatacgctaggacattggtatgtgttctttccgctattttgcgcaatagaggggtgggatgatgctaatgctcccgaaccggaaagaatccaagcgttgctacggctgctggatgttcccgaagcgtttgaagtggcagcatcttacggcaatgagctggatgtcgattatgaagaagaggaaatgcctttccttgtcggttgggagcagccatatcgcaaatggttaaaagaacgaaaaaacgatgaagggatacaagaaggcgaacttgattcattccatagaaacgtaatgtatcaatatattcaacgtcataattttgaagaagcggaccggtatgcctccttgattgcagatgaaaatagtcgtttgcttcaacgttgcgtagttggttacgcttgccaccaatggctaaagacgcaggaaccgggcacattgcctccgtcatgcctgctctctctctttgaggtcaaagaggggtttgaacgcctgagcggactgccgttgccggaacaggaacttgccacttgccgtgtttacctgttgcagacggttgtattgttgggcgattatccggctgtcatcgaaatgcagcaagccttgtttacggaagccatcggcaaactggaacaataccccgaaggagagacaaggcagatgcagcaaatcgcattagcccttagctactaccaaatgctgtacgtcaatcttccggacgaatatccctccaagaaagaattgatgcgaaagagattcccgggattgatggaactatccgatgtcaagcggatatgcggcgagttacttcccgaaaagccgcaaatggcagatacgctacaagaaaacatggaacaatgcaatgccttgatgcaatatcttaactaaaagcgattatgagtttcatcttcagaaaattcaagatggtattgttgctgctgttagtggcggcatactcttacgggcaggcgagagatgcaaagaatttcatcatcaccccgcagaccgtagtgaagactaatttgcccaagctggattcctgcttgtttaagttgcaagagatattgagagaacggttcgggcaaagcgccatcatcggagggaggcgggcaagcggtaattcggttatcgaactttggacagattttgaattggaaggtaaagaacattatatactcaatatatcggcaaagaaactttccatcagaggagcgacgcaaaaagccattcaatacggactgaagaccttggacaaaatcttgcaggaggaaacaaataatacggcgaacaagcaaatagctcctcgccgtattgaaaatgtttccgacagtaattgcccctgatgccttgtgtctatcccatcaatgtgatttcttccaccttgccatcttcgatggtggcatataggaaatgtccggcaaacgtatcttccgtgtcttggaagaagagttccaattcgtaatggatagaaccttcttccttttctttggtctttatatgaacagattgtaattcgatttgcgaggcaaatccctctttggatagtgccggaaagtcacagtcctcccgccatgcgtttgctgttggaagcaattcgtctgccatacgtaattgccaagttgcttcaccttctttttccaattcgttcagatagccactaatggctcgcagatgttttcggacaaggggggcgtgcggacagcgggattccgtttttttaccgtattgcttcttaacgagtttgacagcctcattcaagcattctattttggtgtcggtagaaagcgagggcatttcccaaagttgctcgtataactccaattgtttttcaaacgagcaaaaggcagactttgctccaatctttatatccagataagcgtcataggttttatattcttccttagtcatatctcgttcaacgccgtttagcttgttctgagtttcattcatgcgggtaataataccatcgactaatttcaccaattgacgtactagcttgggtattcttattttgtatttcctcgcatttttttctacactttgcgcatagtatagaatagtggccatcaggatggagatgttcgtgtcggcacgtaccaactcgtctggcagttgtagcatactcacaagattgtatatttcgattttatatggaacgagcctgttgatcttttcttcgacagacaaccctttatcaccccatatcgtgtcgcactctcgaatgattgttttgattctgtcggcgttcatctcatccagacaacgttgctccaacacttcgtccaccttgggcggcaggtgtttcttgagggattttatttttttttgaagttcgttgacatagatctgctgctctgacgggagttgcgcattcttgcttcttgtcgtattctctttgatgacaggcaatgtctcgctcggtgtgcccaaaggggcgatggcgatatgcaaatctaccttcttgccccagattgttgctttatacccttcgggagtctgatagccgcgaaaccatatttggagggtgctgagccaaaactctgtatgaatttccaaagtgacatcgtataggtcggcaattgaccttgtcaaatggaaattccaactgtttttatctgtcgtttgttcctttttcataatgcgggttgtgaagtttattgatttactttggataaagtttcctcagtccattcgcaaaattacaaaaagcagaaacaatccatcaatataggtagattaattacggctttttctttgagctatagttttacacctctgttcatccttgacttcggtattctgatagcttctctaaattcgttcattttctttctgaaccatttaacatgcgaaactctgtttatcttgaaatcataatttccctctgtgctctgtttgagagaacaaaccccacgctttcgggaaagttgatatatcctgagagttaaatggcaaacgtccgtcgttcctcgctatcgaaatttggcatttgccattcttttaataacacatattaagtcagataatttgcgccgtctgtttcatacgagtatctttgcctcactattctgttaaacgataggggagaatgtatcacaagagaaaaataagagcatacatagcatggatgttattcatgacattcattcccttctttgtagtgaaaacctttcactatcatggaagtgaagatgaaacgtcatgctctcatgccgaacattcccggagtcatgccgaggattgtgcgatatgtaaatactccctttctctctttacagaacctcagtcggtagaatttcactgtatattgacgctcgttccttacgagccgattacttatcaggataaggttgtctgcaaacgaacttattcgcatcacctacgcgcgcctcctgccgcataattacatattcatattttctaggaagacaggttcattgtaacttgtcctcacattcattttacacattatataaaagattgtaattgatgcgtatcggaattatttcgggcgtaatagggttgtttgtaaccttatccgtccacgcacagaagtccgattcaatcaagagtatgcttttacctgatgttgttgtgaccgagtcataccaacagcgtcaagccaagaagtctgcacttacggttgaagtgatagaacaggattttctgcgcaaacattttacgggaaacttcatgcaggcaatggagaacattcccggagtacaagctatggatataggctccggcttctccaaaccgatgattcgggggatgggattcaaccggatagccgtactggaaaacggaatcaaacaggaaggccagcaatggggagccgaccacggactggaactggatgcctttaatatcgaggcagtcaatgtattgaaaggtccttcctcactgctttacggcagtgatgccatgggtggagtgattgatatagcctctcctcccataccttctgcgaatatgctcttcggcgatgtcaccctattgggtaaatccgtcaacggaacactggcaggttcgctgatgctgggacttaaaaagaatgcctggtatgcgcaaatccgttattccgaacagcacttcggtgattaccgcatccctacggataccattgtctacctgactcagaaaatgcctgtctatgggcgtaaactgaaaaatacggcaggagtggaacgcaatatcggccttttcacccaatatcagcgaaaaggctataaagcagactattccatcagtaatgtctatcagaagacgggcttctttccgggcgcacacggtgtccccgacgcatcgcgcgtagaagatgacggagacagccggaatatcgagttgccttacagcaaggtaaatcatctgaaagtaaccacacatcagcaatatgcttgggagagactgatcctgtccggtgatttgggatttcagaataaccatcgggaggaatggagtgcttttcatactcattacggcttccagcctgcgccggagaaggacccggacaaagaactggctttcgatctgaacacatacagtgcttcggtaaaagcccgctttattggctcttcttcatgggagcatacgttagggtgggatgggcaacatcagcagaacgacatttccggctattcattcttgttgccggagtaccatcgttctactaccggattgctttggcttacgacgtataagcctaataacattctctctgtcagtggaggcgtgcgatatgattatggttatattggcatctctccgcatgaggacgtttatctggcggattaccttcggaggcaaggatatgatgatgaacaagtagagtcctataaatggaacagtcatgccgtccgaaagcatttcggtgactattccttttctttgggactggtatggacaccctccgttcagcacatggtgaaagtgaacatcggacgtagcttccgcctccccggagccaatgaactggctgctaacggcgtacatcacggcactttccgtcacgagcagggagatgcttctctgaaatccgagcaaggatggcagatggatgcttcctacaacctgcgatatcacggactttccgtttccgtgtctccttttgtcagttggttcagtaactacatctttctgcgtcccacgggcgaatggtcggttctgccgcatgccggacagatttaccgctacacgggagccgaagcactgtttgccggaacggaagctacgatagacattaactttctgcgtcatttcaattaccgtatctccggagaatacgtctacacctacaactgtgacgagcatattccgttaagtttttctccgccgttcggtatgcggaatacgttgacatggcaaagaaaacactgtatgctttatgcggagtggcaactgattgcccgtcagaaccgtgtagaccgtaatgaggaccgtacaccgggggtcaacctgtttcatttgggtggctcgctgaatattccggttggcaggactaacgagatagaaatcaccctgaccgcccgtaatatcttcaataccagatattacaatcatcttagtttttacaggaaagtagaaattccggaaccgggacgaaacttccaattattaatcaaaatcccatttaaaaaattactgtaatgaaaacaaaactttacctcccgataattagccttctggcgatgtctgtatttgcatttatttcttgtgacgattcggatagcgataccaccaaaccggtgattgaactgagcgaaccggaagaagggcaagaactgaaaattggcgacgagcacggagtacattttgaaatggatctgtccgacgacgtcatgttaaagtcttatatgattgaaatacatagtaatttcgaccaccattcgcatggaaagagcagggctgccgctacggacgaagccactgtcgatttcagtttcaacaggtcttatgatatctccggaaagaaaacggcgcacatccatcatcacgatattataattccggccaatgctactccgggcgattatcatctgatggtttattgcacggatgccgcaggaaacgaaacctacattgcgcgcaatattgtactgagcactaccgccgaagaggacgatcatcatcacgatgaataactgaaagagcctgcctgccatgcaaaacggggggcgggatggagtatcttttttctcttattaatcagtgttcgtataattttctttaaaaggtgtaatagttattacaccttttgtgttttcaaagctttacttttgtgaaaaatactttttcactatgatgaagttaccatttataaaccgaatttttccttcgtacagatcaaggatagtagccgttatcattggcggtattattgtaggcggaggagctttatttatgtatatgcttcgggcacatacgtatctgggcgatgatccggcagcgtgtgtgaattgtcacatcatgtctccttattatgctacatggtttcacagttcacatgcacgggatgctacctgtaacgattgccatgttcctcacgagaacattgtaaagaaatggacattcaaaggaatggatggtatgaagcacgtagctgcatttctcgccaaaagcgagccacaggtgatacaggcccacgaggccagttcgcaggtgattatgaataactgtatccgttgccatacgcaactgaatacggagtttgtaaaaacaggaaagatagattatatgatgtctatggtgggagaaggaaaggcttgctgggactgtcatcgggatgtacctcacggtggtaagaattcgctgtccgctactccggcagctatcgtccctcttcccgaatcacccgtaccggaatggcttcggaagatggttaataataaggaataagcatatgcataactacgtaataaaataataaaaccgatatacaatggaaaagaaattaaaatcatggcaaggatggctgttgttcggaggttcaatggtcgttgtttttgttttaggattatgtgtttctgcgttgatggagaggagggcggaagtcgccagtatctttagtaaccgcaaaactgtcattaaaggtattgaagcacgcaacgaactgtttaaagataattttccccgcgaatatcagacttggacggaaacggcaaagactgattttgaaagcgagtttaatggcaatgtcgctgttgatgctttggaaaaacgtccggaaatggttattctgtgggcaggatatgcattctcaaaagactattccactccgcgcggacatatgcatgctatcgaggatatcacggcgtcacttcgtaccggttctcctgcaggtccgcacgatggtcctcagccttctacttgctggacttgtaagagtccggatgttccccgcatgatggaagcattgggagtcgattctttctataataacaaatgggctgcctttggtgatgaaatcgtgaatccgatcggctgttccgactgtcacgatccggaaacaatgaatcttcatatcagccgtccggcattgattgaagctttccagcgtcagggaaaagatatcacaaaagctactccacaggaaatgcgttcattggtctgtgcgcagtgccacgtagaatattacttcaagggtgacggtaaatatctgactttcccgtgggataaaggtttcactgtagaagacatggaagcatattatgatgaggcaggtttctatgattacattcataagttaagccgtactccgatcttgaaagcccagcatcccgactatgaaattgctcagatgggtattcacggacaaaggggcgtttcttgtgccgattgtcatatgccttataagagcgaagggggcgtgaaattcagtgatcatcacattcagagcccattggcaatgattgaccgcacctgtcagacttgtcatcgtgagagtgaagaaacattacgtaaaaatgtgtacgagcgtcagcgcaaggcaaatgaaatccgtaaccgtctggaacaggaactggcaaaggcgcatatcgaagcaaaatttgcctgggataagggtgctacagaagatcagatgaaagatgtgcttgcattgattcgtcaggcacaatggcgttgggacttcggtgtggcatcacatggaggttctttccatgcaccgcaggagattcagagaattctttctcatggtttggaccgtgctttgcaggctcgtctggctgtatccaaagttttagcgaagcatgggtatacggaagacgttccgatgccggacatttcaacgaaggccaaagcgcagaaatatatcggtcttgatatggatgctgaaagagctgctaaggagaaattcctgaaaacgaccgttccggcatggctggagaaggcaaaggcaaacggacgtctggcacaaaagtaaaatagggatatatgtggagcaaaccgtggagttataaagaagggctggtgattggtgcgggattactggtgataggtattttgctgcaaatggcagtgggagccatcaactggagcctgtttgcctgtccggtcaatgtgattgtgttagtggtttatatcattgcgctggtagccatgcaccttcttcgtaaacgtgtgtatctgtttggatggttgagccattattccgctgccgtttcttccttggtatgggtagtcggcatgacggtgatcatgggacttatccggcaggctccttccggtcacgcttccaatgatatactgggattttcacagatgatttcgtcctggactttcgtcctgctttacttttggatggtcactgcattgggattgaccatactccgtgccagctttccattcaggattggcagactatcctttcttctcaatcacgtaggattgttcgtggcattgattacggctactttgggaaatgccgatatgcaacgcttgaagatgactacccgaatgggaaacgcggaatggagggctaccgatgataaaggaaaattgatagaacttccgttggctatcgaactgaaggattttacgattgatgaatatcctccgaaactgatgctgattgacaatgaaacggggggagtactccccgaaaagtctcctgtgcatttactgcttgaagacggagtttccgagggcagtctgctggattgggacttgtttgtcgagcagtctattccgatggctgcctccgtagctacagaagacacattgaaatttacagatttccattcgatgggagcgacatatgcagcgtatctgaaggccgtcaaccgaaagaaccaacaggcgaaagaagggtgggtgagctgtggtagttttctctttccttataaggcattgcgtctcgactctctgacgagcctggtgatgccggaacgggaaccgcaacgttttgcatcggaagtaaaagtctacacacaggaaggaacgataacggaaagtacgattgaagtaaatcgtccgatggagatagcaggatggaaaatttatcagcttagttatgatgagtcgaaaggtcgctggagcgatatcagcgtctttgagctggttcgcgacccgtggttgcctgtagtatatgcagggatcatcatgatgatgctcggagcaatttgtctgtttgtcaatgcacaaaagaggaaagaggaggacaaggaatgagttgggaacattttatatggtttgcgatagccgcattgatttgctggagcttgggcgcgtttgctgcctggaaaggaaagaagccggtatggacctatggatttaccttgttggggctggtcatctttttcagttttatcctcggtatgtggatttctctggaacgtcctccgatgcggacgatgggagagacacgtctgtggtattctttcttccttccattggctggtttgataacgtacgtgcgttggaaatataaatggattcttagtttcagttgcattctctcactggtatttatctgtatcaatatctttaaaccggagattcacaataaaacgctgatgcctgctttgcaaagtccgtggtttgcccctcatgtcatagtctatatgtttgcttatgcgatgttgggagctgcggtggtcatggctgtttatctgctttggttcaaaaagaaggatattgaacggaaagagatggacttatgcgataacctgacttatgtaggcttggcatttatgacattgggaatgctgacgggagctatctgggcgaaggaagcatgggggcactactgggcttgggacccgaaagagacatgggcggcagctacttggttctcctatctggtatatatccatttcagactgggcagaccgttgaagagtcgtccggcattagtcattctgttagtatcatttgtcttattacaaatgtgttggtatggaatcaattatcttccatcggcacaaggagttagtgtacatacttataacttaaattgaaatatcaatgaaaacattttattggtcattcgttcttatgctattgccaagcatggcatacacacaaactacggagaaggaaaatgaattttcgatgtctatgcaaatcagacctcgtgcggagtatcgaaacggtgctttagtccctcgcaatgaagggcagaaggctgcatcatttattaataaccgtgcccgtttgtcactggactacaagcgttcggaccttgaaatcaagatgtcggcacagcatgtcggagtatggggacaagatccgcagattgacaagaatggtcgctttatcttgaatgaggcatgggcaaagctggattttggaaaaggcttctttgcacagttaggtcgtcagacgttaatttatgatgatgaacgtattttgggcggactggactggaatgtggcaggccgttatcatgatgcgttgaaactgggatatgccaataagaataatgaaatacatgctattctggctttcaaccagaatgatgaaaaaacggcaggtggtacttattacaattcttctattggtcagccttacaagaatatgcagactgtgtggtatcactataaagcagataagattccgttcggggcttctttactgtttatgaatttaggattagagacagggaatcagctcactcaagattctcatacccgctacttgcaaacgatgggaacttatcttacatataaaaatagcggatggaacctggatggcgctttctactaccaaacaggtaagaacaaggatgccgagagcgtttccgcttttatggcaagtgctacggcagcttatgcgttcaataagacatggggaatggttgtaagttttgattatttgagcggaaatgaagaaggtagtagtaaatttaaggcttttgaccctctttatgggacgcatcataaattctatggcagcatggattatttctacgcttctgcattcaacaaaggatttgctcccggattaatagatggtcgtcttggggctcgttttcgtgcatctgccaaggtagatatggaactcaattatcattattttgctactgctactgaagtagattttaaagaagatttgaagaagtcactcggttcggaagttgactatcagatcaattggtctgtaatgaaagatgtgaaactctctgccggttattcttttatgcttggaacgaagacgatggatgctgtgaaaggtggaaatcataagagttggcaagactggggatgggtatctgtcaatatcaacccgaaagtgttttttacaaaatggtaattgaaacctagctaggattcagattaaaccgttgatagaatataaaaagtggcacagcattaaatttaggctgtgccactttctttttattataagtatttctccagcgccattttattcagaatctcgatcttttttccttccattgtgatcagtccttccttgattatcttattgatttctttggataaagcaggacgtgatacattcagatactcggcaagctgtgactgggtatgcatgatctctacagtcagagaatcttttttcttatgttcgaataagtaaacaataaacctttcgcgtacagtcttgcgcgacagaggtttcaaacgtgatacggtacatatattgcaatttccggcgatgcaaagaaaattgtgcaacacctgcgggtcctgactgatgactttaaaagtggaatctttggttgccatgagtaccacgctgtcttccaaagcagtaaaagtagctggcaacgtattgtttgaattgaaaaggtgaggggtggcaaaggtacgtggtgcgatgatatactcaatcatcacttcgttccccaatccgtcaatgatatccgtgcgtagttttccttccaataacacatatagtttgttgcaaggtgtaccttgcgtaacaactatttcttttttatccgctgcatagataacgaaatccagtttgtccaacagagattccttaatgttcagaggtaaatcccgaaataaagggatttgaaataatttttctttatgtgcgttggtcagttgtatttttttcattgcattatgttgttcgtatcatgggcaaagatatgaattatatatgggcagagaaaatctttttttatgtttgtgccgccgaaagaccgattatggatgagatgaaaaggatattgataaaaagtaaaaatggcagaaaatgtttgaatcagtaattagggtacacatctctgtaatttatctacatttgctatatgataaattgtctatttttgcagagtgaaaaagctgattaatgaaattcaaaaaataaaagtaataaagttatggctaaaaaagttctgattatttcgtccagcccccgaaagggcggtaattctgatatgctttgtgacgaatttatgaaaggtgtcctcgaaacaggcaatgaagtagaaaagatttttctgaaagagaaagcaattcatccttgtacgggatgtagtgtttgcagcatgtatggcaaaccctgcccccagaaagatgatgccgcaggaattgtagagaaaatgattgctgctgatgtcatcgtaatggcaacacctgtttatttctatacgatgtgtggacagatgaagattatgattgaccgttgttgtgcgcgttatacggaaataacgaataaggaattttatttcattattgcagcggcggagaatgataaggggatgatggaacgtacgattgatggtttccgtggcttccttgattgtctggaaaatccgcaggaaaaaggagtgatttatggaataggtgcctggaaggtaggagaaataaaagatactccctacatgcaggaagcctatgagatgggaaaaatggtgtaaacgttcgctttaggtaaacatttcccgtcttatataacaacctttcaggatggtgtcactatgctgagtatatagtgacgctatacctgtaggatagtgacactaaagcagtatgatagtgacactatagtaatgggatagtgacaccatatttttgtctggatttaatgagagaagtttagtttaatgattctgttacaataatcttctttcgttcgattccagttccaataaagtctttttagctacaagaccaccggcatatccggtcagtttatgatcactgccgatcaccctgtgacaaggaataagtattgaaatagaatttgctccattcgaagaggctaccgcgcggatagctttaggattatccagtctctgtgataattgagcataagatatcgttgttccgtagggaatgtttaataattcattccatacactcttttgaaactctgtcccgacaagaagcagaggaatatcaaacgtagtcctttgacgggaaaaatactcatctagctgactgatcgtttgcgttatcacttcagagttttctattgcgtactgagcatttagcgctttttgtattcgtttatcgattgttgctctgcgttcttcactcaccacccagtcacacatacagagcttgttctcgaaagaaccgagtatcaatttcccgcatggagattgatagtactgtatctgaactgtatttactttaccttttgcttctttctccattttgattctttatttaaagggtttgatatggatgtaaaagtaattatttgtattcaaactacaaaatgaataattcggcaatagaagcctgaaacaaaatcttttacccttacagtcgatttaaattgattgattacttgttctgccgtagaattattataattttgtagcagaactttttatttcgtagtatttgattaagaaccaaaccacatgaactataaaataacgactcttgtcgaaaattgtgtctatggacgtaaattgcaggcagaacatggtctttccctctatattgagacaccggaaaacagattactttttgatacgggagcttctgatttatttatccgtaacgcccggttattgaatattgacttgcaaaaagtagattatttagtattatctcatggtcacagtgaccatacgggtggactacgccattttcttgaactaaatgccgaagcaacggttgtttgcaaacgcgaagtgttttttcctaaattcaaggatgaacgtgagaatggaatgaaatatacacgctcgcttgatctttctcgttttcgttttattgatgagttgactgaactggttcccggagtatttctttttccctctgtggatattatagaccggaaggatacacattttgaacgattttggattcaaaaggaagatggttctagagtccccgatacctttccggacgagttagctatggtactggttgagcctgaaggactttccattttaagtgcctgttcccaccggggtattacaaatatattgcggactgtaagaacggcatttccggaactcccctgtaatttgcttttaggtggatttcatgttcataatgcagaagaatccaaatatcaggttattgctgattatttgcacgaatatttacctcaaaagataggtgtctgccattgtacgggagtagataaatatgctttcttctataaggattttggagacagaatattttataaccatacagggaaattgattcagacggattctctgttataattatctgagacgactaaacaagaatatataaaaacaaactggatgaattttaaagactgcatagattcttatccctttatattaatggaaggtgctttaggcgagcgactaaaaagggagtttgatttggatatcagtggtactgttgcaatggctgacttagtctatcagcagaaaggtagactggcattagaaacgctatggaatgaatatattgatattgcatataggtatcaactaccatttcttgcaacaactccaacaagaagggccaataaagaacggatttatatggctggatacaatgaatccattattgcagataatgtggattttcttcgttccataaaagaagcagcaaatgtagatatgtatatcggtggtttgatgggatgtaagggagatgcatacactggcgaagaggctctaaatctggaagaggcaatagacttccatagttggcaggccggtttgtttaaatctgccaaagttgattttttatatgcaggtattatgcctgtattgacggaagctatcgggatggcagtcgctatgtctgatacggatattccttatattatcagctttacgattcaaagagacggaaaactgatagatgggcataccattgatgatgccatacattgcattgataatcatgtgtctaacaaacctgtgtgctatatgacaaattgtgttcatcctgatattgtttacgaagcactttctcataagttcaatcaaacacaaacggtaaaatctcgcttttggggtatacaagcaaatacttcccaattgtcatataaagaattggatggagcaaatcatttacatacttcttcggcagccgatctgagtgaagctattttaaagttgaaatctgattgtcatcttaaaatatttggtgggtgttgtggaacagacagcagtcacatggaaaaaatcgctaaaatatcggaagtgacttaaactaactagaaatacggtcttctcatgaaacaaggaatatagaataaatatataaacatacaataatatgaagaaaataatcatctctttagcgctggtactgactgcattatccagctatgctattactcctttgtggatgcgtgatgcacgtatctcaccggacggaaaggaaatcgtcttttgttataaaggcgacatttacaaagtccccgttcaagggggaaccgctacccaattaacaacacaagcttcttatgaggctaatcccgtctggtcgccagatggtaaacaaatcgcgtttgccagcgaccggaatgggaacttcgatctctttatcatgcctgccgatggaggaactgcacgtcggttgacttatcattctgcctcggagattccttcggctttcactccggatggtaaatttgtacttttctccgcctccattcaggaccctgcgcaaagtgccctttttcctaccggagccatgacggaattatataaagttccggttaccggaggacgtaccgaacaagtgttggctactcctgccgaatgggtatgctttgataaatcgggaaaaaacttcctttatcaggaccgtaaaggttttgaagatgaatggagaaaacaccatacctcatctataacaagagacgtttggctatacgatgcttcgaccggaaaacataccaatctgaccaatcgggaaggagaagaccgtaatccggtatatgcaccggatggtaattcggtttattttctaagtgagcgcaatggcggttcatttaatgtatataactttgccctgaacactccgcaggaagtgaaagccatcaccactttccgcacgcatccggtgcgtttcttgtcaatcagcgataaaggaactttgtgctatacgtatgacggagaactttatacacaagagcccaatgcccgcccaaagaaagtaaatgttgatcttgtgcgtgatgatgaaaaagagattgccactctcagattttctcagggtgcgacttccgcttctgtgtctccggatggtaagcaggtggcttttattgtgcgaggtgatgtttttgtgacttcaaccgattatgctacgaccaagcaaataacaaatactccggcaaaggaagccggtgtatcttttgctcccgacaaccgtacactggtttacgccagcgagcggaccggcaactggcaactttatactgctaagatagctcgtaaagaagaggcgaatttccctaacgccactctcattgaagaagaagtattgcttccctccaaaaccatagaacgtgcttacccgcaatactctccggatggtaaggaactggcttttatcgaagaccgtaaccggttgatggtactcaatctgaaaaccaaaaaagtacgtcaggtgacagacggttctacatggtacaatacaggaggcggattcgactacgaatggtcgcccgatggcaagtggtttacgcttgagtttatcggcaatcgtcatgatccctattcggatatcggcattgtcagcgcgcagggaggtactatcactaatctgactaacagcggttatattagcggctctccacgttgggtgctggatgggaatgccattctgtttcagaccgaacgttatggtatgcgtgcgcatgcttcctggggatcacaacaggatgtgatgctggtattcttgaatcaggatgcttacgaccgttatcgtttgagtaaagaggatttcgaactgctcaaagaatttgaaaaggagcagaagaaagcaaaggagaaagacggtgataagaaaaaggacggaagtaagtctaaaaaggaaaaggcagacaaagaaggagataaggaggataccgaagaagacaaggcagacaagaaagatattgttgtggaactcagcggtattgaggaccgtattgtacgcctgactcctaactcttctgatttaggtagtgccattctttcaaaagatggagaaaatctgtattacttctcagctttcgaagaggggtatgacctttggaaaataaatcttcgtgaaaaagatacgaagcgtctccataaacttaattccggctggtcatcactgatgctggataaaaaaggagatatcttcttgctgggaagcagaaatatgcagaaaatggacgcaaagtcagatgctctgaaatctatcagttatcaggctgaaatgaaaatggatttggcagccgaacgtgaggcaatgttcgatcatgtatataaacaacatcaaaaacgtttctacaatcttaatatgcacggagtggactgggatgccatgacagctgcctatcgtaaatttctgccgcatattgataataactatgattttgcagaattactgagcgaatggttaggtgaactgaatgtttcgcataccggagggcgctattctccgaggggcaatggggatgtaacctctaatctgggcttattgtttgactggaattatctgggaaaaggtatgcagattgctgaaatcgtagagaaaggcccgttcgatcattcccgtaccaaagtaaaggcagggtgcattatagaaaaaatcaacggggaagaaataactccggataaggacatcactgatcttttgaataataaggcagggaaaaaaacactggtttcgctgtacaacccacagaataaggaacgttgggaagaagtggtaaaacctgtcacaagcggacagcttaatggcttattatataaacgttgggtgaaacaacgtgctgaggatgtggagaaatggtccggcggtcgtttgggatacgttcatattcaatctatgggagatggcagtttccgtactgtttactcggatattctgggaaaatacaataactgtgacggaattgtgatcgatacccgttttaacggaggcggtcgtctgcatgaagatattgaaattcttttcagtggtcagaaatatttcactcaggtggtacgcggacgtgaagcctgtgatatgccaagtcgtcgctggaacaagccttctattatgttgcagtgtgaagccaattattcgaatgcgcatggcactccgtgggtgtacaagcatcagaacattggaaaactggtaggtatgcctgtcccgggaactatgacaagtgtatcttgggaaactttgcaggacccttcattagtatttgggattcctatcatcggctatcgcctaccggatggcagttatctggaaaatactcagctggaacctgatatcaaagttgccaacagcccggagacggtagtgaaaggagaggacacgcaactcaaaatggctgtagatgaattgcttaaagaaatagatagccggaagaaatagacatcgtttgtttgtgttaaaagaaccgaaaaaaagagcttattgaaatgatgtgtccaacttattcttacttttgtgtttgacaatagtgtcaaactaaggggaacatagtgtagaacatgattaaaataggaattgatgtaggttcaacgacggcgaagttagttgccgtcgatgaaaatgataatctattattttcaaagtacgagagacacaatgcgaaagcaaaagagacaattctatcattcttgaaagagctgttatctgaaatcggagataaagatatttccgtgaggataacaggctctatcggaatgggaatttcagagaaatgttcgttgccgtttgtacaggaggttgttgcggcagcgaaagcgatacaaaaggattattctcatgtgacttctatgatagacatcggaggagaagatgcgaaagtcgtcttctttaaggatgccgaagcgaccgatttgcgtatgaacggcaattgcgcaggagggacgggcgcttttattgaccagatggcgattatactgggagtgaatattgatgaattgaatcaacttgccatgaatgcgacacaggtatatcctattgcctcccgttgtggcgttttctgtaaaacggatattcagaatctgatagctaaaaatgtaagtcgtgagaatattgcggcttccatctttcgtgcggtagcagttcaaacggtagtgacgctggcgcacggttgcgatattacaactcccgtattgttttgcggtggtccgttaaccttcattccggcactgcggaaagccttcattgattatttgtccctcgatgaaaaagagatcatactgccggccaacggcactttgctccctgcactaggtgctgctctatttcatcttgataaagaggattactgtaaactgtcccatttgatcgataagattgacactactttaaacggtaacggtaaccttgcttcaacagggttggaacctgtttttgcaagtaatgaagaatatgaagcatggaaagaaagaatatcccgtcataagatgatatcttccggcttgaaagccggaacacaggatgtctttatcggcatcgattcaggttctactacgacaaagattgttgtactggatgaagattcaaggcttctgtattcttattataatattaatggcggcaatccgataaaagctgtggaagaggggctgaatcagttgaacgatgaatgtttgaagcagaatgccgtactcaatataaaaggaagctgttctaccggatatggggaagaccttatcaggtctgcctttcagcttcattcggggattatcgaaacgatcgcccattatatggcagcgcattatctgaacaaggatgtgtcttttatcctcgatatcggcggacaggatatgaaggctatttttgtgaataatggtgtgattgaccggatggagattaatgaagcatgctcttccggatgtggttcttttcttgaaacgtttgctaaatctctggggtattcggcacaagagttttctctggcagcctgccattcggaagcaccgtgtgatttgggaacaaggtgcaccgtttttatgaactcaaaagtgaaacaggtactcagggagggggcaacgatcaatgatattgccgccggactggcatattccgttgtcaagaattgcctgtataaggtgctgaaactgaaagatatatctgttttgggaaaagatattgttgtgcagggaggcaccatgcgcaatgatgcggtggtccgtgccattgaacttctctcgggagcggaagtggcaaggtgtgatacacccgaattgatgggagcattcggatgtgcattatatgcgatgaaacatcagggggagtccgtatcattggatgagattatcaataaagctcaatattcggcacgttctttatattgcaagggttgcgataatcgttgtctggtcattcgttacgagttcgaaagcggcaaaagttactattcgggaaacaggtgcgagaaagttttcacgaatggagagagcagtaaccggaaaggtctgaatgtctatcggcaaaaagaagagcttttgtttcatcgcagcgcagagattgcagcacccgagcagattatcggaatcccccgatgtctgaatatgtacgaggaatatccattctggcacactcttttcacttcctgtggcatacaagtctgtttgtctgatccgtccaatttcagaaagtatgagcacaatgcgcgtatggtgatgtcggacaatatctgctttccggctaagctggtacatagtcatgttcaggacttgatagaaaagaaggtcgaccggatttttatgccttttgttattttcgaaagaaaagggatggaacaaaacagttataattgtccgattgtgacaggttattcggaggttatcaaaagtgtgcagtccgaaggtatatcggttgattcccctgcaataactttcaaagaccggaatctgttgtttaaacaatgccgtgaatatctgagcggtttgagcgtggacgatcggacgattcagcaagcattccaaaaagcggaaagcgaacagcactcttttattaatacattggtcgattataacaaaaacatattgcagcagactggaaagggagagactctgactgtcatgcttgccggacgtccttatcataccgattctctgatacagcacaaagtctcggatatgctttcggatatgggagtgaatgtgataacggatgatttggtgcgtcagatggatataccgacgggtgatgcgcattttgttgctcaatgggcgtatacgaaccgtatcctgaaggctgcgaaatggtgtgcgacacaaggaaagaatattcagtttgtagagatgacttcgttcggatgtggaccggatgcttttctggtggatgaagtaagggatttgctgatgcgtcataacaaatcgctgactttattgaaactggatgatatcaataatatcggttcaatgaagttgagagtacgttccatgattgaaagcctcaaacttgcgaatgcggatggaacggaaggcgatgtaaaggactttacgaccgttcctgtctatgacaagtcttaccgtgaccgtaagatactggttccttactttactccgttcatttcacctttgattcctgctattatgaaagtagccggttatgatgcggaaaaccttcctctcagtgataatgattcaagtgaatgggggctgaagtatgcgaataatgaggtctgttatccggctactctgatagtcggcgatattataaaagcacttaaaagcgggaaatatgatatttcaaaaatagccgtagccatcacccaaacgggaggacaatgccgtgccagcaactatatttccttgataaaaaaggcgttggtggatgccggatatacggatattccggtaatctctatctctgtgggcagtgacatagataatgaccagcccgcgttcaaggtcaactggatgaaagtagtaccgataacttttcatgccgttttgtatagtgattgcattgctaagttttattatgcgtctgtggtacgtgagaaagaagcaggtgcatcggcaaagctgcgtgataaatacctgcaactggcacctgaagtgatactgagaagaaacataaaggggttgaactctttgttgcaatcggcaatcattgaatttaatgaggtgtgtagggctgtagatactcctaaagtcggaattgtaggagaaatcttcttgaaattcaatcctttcgcacaaaaagagatcattgattggctgataggccgcaagatagaagtggttccgccgattctggctgactttttcatgcaggggtttgtgaacaggaaagtcaatacggattcttacataaaaaacagacagttgcctgagtttatttacgactggatctacaagtttgtaaagaaacagattgataaaataaatgagacagcaagtaagttccgttactttgcccccttcaatgatatctttgaagaagcggaaggagctaaaagcgttatttcgctgaatgcccaattcggtgaaggctggttgttgccggctgaaatcgtgtcttacgcccggcaaggggtgaacaatgtagtgagtttgcaaccttttggctgcatagcgaatcatatcgtatccagaggagtcgaaaaacgtataaaaagtttctatccggatataaatttgctatctttagactttgatagtggtgtgagcgacgtaaacataacaaaccgtatgcttttgtttattgataatctgaaaaatgcgacaatgaattatgacaacaactaataataatgaagatttggagaaaaagataattgaggctgccaaagaactatttatagagaatgggttcgcagaaaccagtatgagtgatatcgctgctaaagtaggtatcaacagaccggcacttcactattatttccggacgaaggataagatgtttcaggccgtttttggtaacatcatactttcttttattcccaaaatacatgatataatcattcagcaggacaaacctgtctccgagagtatcggtgaaattgtagatgcttattataaagtattcacggaaaatccatgtttgccattgttcatggtgagggagatgcatcgtgatatgaatcatttaagcgatactatcaaggagttgcgcctggaacaatatctccataaaatcatggatgttttacaggaagaaatgaatgacgggagactgaaaacagttcctttgccattcgtattctatactttttatagtgcattgacagttcctttcctgacaaagaatctcagtgcttctttctttttggagaaggatgattcttttgaggatattctggttcagtggaaaccttatatcgtcaggcagatggaaacgttgctggtagtgagctagagaaaacttatttcaatacaggtaataatttgtagagagtcttccttgtcattattttctgattcaggaagctgacgatatatccggtgatgcaggcggcgataagagacccctcgcgaacaccttcgatgcattgtgaaagcaggagagagagtatgactgccagagtgaccagcgtaacatcaaaacagactttgaactttccaaactctttgttataacggcgggaggcgtattttacaaaagcctctgcgctcatcattgctactttgggtttgagttcgagtacgactcctatggattgtatcatgcatcctgtgagtaataaggctattgacatcccgtaattgtcgggatgcagattactggtgagcgccatattaaaatcaatgaatgccgaaaagataaaagagaacggcaattgaaggagtatttcaatggtgtcctgtcgggtcctattttttctgatgacccagaactgtcccaggataagcagcatattgatcagaaacgtacaagttcctaatgataaagggctgttcaggcttaacacataattgatgctggatataggtgtggttcctaatgcagaacgcacaatcaacactattccggcagccagaaaatacaatccgataacaaataccaaataccttttaaaaacgtctttcattcccatatcttactatcttatataatcgtatttttcttcattctataaagaagaatatgcaaaggtcccgttttttcgtctgatataagttatccgattccacacagtttttgtcatatccgaaacaaattgtatttttacgtcgaaaagaaggaggtataaatggtaaaatctcgtatttttgataataggcagttgttaaaggaacatccggaaattcctcattataaagaggaagtagtctgctttatgagtgaatataaggacaggagctatccggaaaacgaacgttactttaatcgtgaactttatatgatactcgttcttgaaggtcgttccgagattttgctgaatggggaatttattgtgatagagcctgatatgttgcttgttcatggagcgaattatctcaccgatcatctttattcgagtccggatattaagtttatcaccctctccatttccgagtccatgcggacagatgactcttatcttacccagataacggctattctgttggcaacgatgaggcagaataagcaatataccatacagctgaccgcatacgaagctcaaatcattcgtaatgaactggaagtgttgatgcgtttgctgaatataaaacatcagtttcttttccggcgaatacaggcggcttgcaatgccttgtttttggatatagccgattttctttcccgtaagactatcataaaaaaggaggtcagtcgtaaagaccatgttttacaggaatttcatgcgcttgttacccgaaatttcagagaagagcatttcgttagtttctatgcggataagttggccatcagtgagcagtaccttgcacgtatcgttcgtgccggaacgggaaaaagtgtgaatacgattattaatgagttactgatcatggaagcccgtaccttgctgagttccacaaaatctacggtaggggatattgcttcccggcttggctttagtgatgctgccggtttctgtaagtttttcaagaggaatatggggcagactcctctcaattatcggaagggattatggatttaagtgaaaatgaatgtaggttgatgtgatcccataacgaacggatacatcaacctacatgaaatatataatgaactggttttgacttatcagccaatgagtgataggatatcttctacgatctgttcatccgtcagatggttggcacgaagcagttcctgtatatcataacggtctacaaattcttttttagctccgtagttgagcactttcatatctgtagcgccatagtaacgggcaatcttttcaccgaaaccaccatccagaactccgtcttccagtgtaatcactaattcgtggtcggctttcagttcgtccatcagttcgctgtccacacctgtgatgtagcggggattgataagggtggcatcaatgttggctttttctttcagcagtgacagaaccgattgccctaatccgaagaaggagcctaatgcaaggattgctactttggagccacggtgggcgactttataacgattgagattgctatagtcggattccaccggttcaccgcaactgattacatctgtggcaggtacacggatagctaccggatgctcattttggtggatgctccattccagcatggcgagatattcctccttacaggtaggtgccagatagaccatattggggatattgctgataagtggaatatcgaagaaacagaggtgagttacatcattcataccggataacgtcccccagaataccaacagaactgccggattattattgatgcagaggtcttgcgatagctggtcgtaagaacgttgtataaaggtgctgtacactccgtaaaccggttttccgccattggctgcgataccggaagcaagtgccactgcatgctcttcggcaataccgacatctacaaactgcttgcctgcttcctgacgacggtcgggagtgaagcccaaaacagcgggggtgcccgaagtaatggtaactacacgcttgtcttctttcatctttttcagcagatattgagcggttacttcactataatcttctgcgtcgtcgttcatttttgattttccggtttctagatcaaacggagtacgccagtgataggtctccttgtcctgttctgcaggttcgtaacctttgccttttaatgtattgatgtggactactatcggatgctgtatatctttaactttggagaaagcctcgatcagtgcttccacacagttgccgtcattcacgtacatatagtccagccccatcgctttgaagaaattgcattcacattgaccgttactgtcgcgcaaatctttcagatttttgtataagcctccgtgattttcggcgatggacatctgattgtcattgacaataataatcatgttagtaccgagctctgctacgtagtccagtccctcgaaggcttcgcctccgcttagtgaaccgtcgcctattacagcgatgatattttcgttgccgcctgtcaggtcacgtccttttgccagtccgcttgccaagctgacagaagtagaagtatgaccgatcacaaagaaatcatgttcactttcctgtggttctgagtagccggatacatgatcatattcagcaggatggagaaaagcatctttgcgtccggttagcatcttatgtacataactctgatgtgacacatcatatacaattttatctttcggcgaattgaaaacatagtgcagggcaatggttgcttctaccattccgaagttagggccgaagtgcccaccgtgtgcactcagtttttgtaagagtgatgcacggatttcatgacttaaatcattcagttcctgaaacgataacttctttacgtctgcgggagagtaaatattttctaaatacatatcaatttgtttttttatgtttatacctatatttttatttcactgcaaagatactgacggatttgaaatctgtttgtatatgaattacggattcttttacctatattacagttccgctaaaaatgggcttgataaaacataaaatacgacttcctctatatcaaccatatgctcttttgcaagcttgattctttttacctgaatatactgttgtaataggtatcgcgcacgcgtaatcattatataatagcaaaataggatgctataataatatctgttcttgtgtgatagaaagatggaaacctataatctgtaattggggtaattatacccgtaatctgtctacaatcccttcacttaattcttccgacctttgtactgtcgaatcaccttgagtatatggaactaattatataaagaatatggatagaaaaggcttcttgaaaagtacgatgatagcaaccggaagtttactgttaggcggggcggggatttgtcggtttctgaatgataaagaacccgcagatggtccgtttccccggacaatagaaaaaatacattgtggaaatatgaaaaaggtacttgttataatgagcgcggggacaaaactcggtaatacagaccggttgaccgacgcttatattaaaggactcgtggaacggggacattcggtaaccaaagtatatctgggcagtatgcggatagaaggctgcagaggttgcggcgtatgccagcggctcgctcatcaatgtgcagttcgggatggtatgcaggatatatatcctttgtttgcagaatgtgacacagtggtcatggcttcacctttgtatttctggacaatcacgtcacagttaaaagcttttatagacaggctttacgccatctctgccgacgacaagtatccgcagaaagatacggtattactgatgacagccggtgacgataatgagaacacctttgaccaacccaagcagtatttccggcttctgagccaggcattgggttggaatgaagtcggaatatattgtgccggcggttgtaccggatgcgaaaagctggcacggcaaatagataaggtacatcttgaaaatgtctataaaatgggattggaattgtaaatagcagatttaatatggaacaaaagaatcaatcaaaacttcattcgggcggtttgctcgtatttatcctcacggtcggtgtgtttggtattataaataccgaaatgggggtagtgggtatcctgcctctaatagccgaaacttttgatgtctcggtgccgcaggcaggttggacagtgagtatctttgcactggtggtagctgcatcggctcctgtcactccgttattgtttttgggagtaaaccggaagaaagtcatgttgctggcattgggattgtttacactgagtaatattatatccatgctcactaccaattttacagtactattggttgcgcggatacttcccgcctttcttcatccggtatatgtttcgatggcttttacagtagcggcggcatcagtcagcaaggaaaaggctccaaaggctgtttcaagggtttttgtcggtgtgtctgccggtatggtgctgggtgttccggtgaccagctttatagctagtgaggtctcattctctatgtcaatgctgtttttcacagttgtaaatgccttggttcttatagctacgattttgtttatcccctccatgccggtaaaggagaaagtatcttatggtgcacaactcagcgtattgaagagaacggtgatgtggaactctatcattgccgtcaccttgattaatggagctatgttcggcttctttagttatatgtcggactatctgaaaacagtgacggaagtatcatacagtgtgattagtgttgtattattggtctatggtctggctaatattgtaggtaacgtacttgccggaaaactattatcgataaatgcgcggcgttcaattattatcatgccttttgcattgctggtttcctatatatgtctctttataacaggagagtggattacagctatggtaatcattattttaattttaggtgtattggcaggtatagcaagtaataatatgcaatatatgatcgcggaagctgctcccgaagctcccgactttgccaacggaatgtttctgacttctgccaatttggggacaacgatcggtacagccgtatgcggagctttcatcacggaaatgggcacacgctattctgtattcggtgcattgtttttcctgattgccagtattgtgtttgtttatttgagagttcgtgtagctcattcacagaaacaagttaaaatgaatatggcaacggaatgatgaaaaatatataatccgtaattggggtaataatgtcagtaattcatctacaaacactctctttatttcaccgtatttttgtaatgtagaaagtagacaatcaattcattaataattaaatgtaagagatatgaaacgaatattattattaaccgttgtatttattatgatgcttggaaccagtttttctttcgcacaggctgatgcggataacttttataaaagtgattgggtaaaggtagaaaaggtttctttttctaaccagtataaaatgaaagtagccggcaacctgtttttgccgaagaccatgaaagagggagagaaatatcctgccatcattgtcggacacccgatgggagcggtcaaggaacagagtgcgaatctgtatgctactaaaatggcggaacgtggtttcgttacgctgtccattgatttatccttctggggtggaagtgaaggtgagccgcgcaatgctgttttgccggaggtatatgcggaggatttcagtgccgcagtagattttttgggtacacgtccgttcatcgaccgaaataatataggtgtaatcggaatttgtggcagcggaagtttcgctatcagtgcggccaagatagaccctcgtctgaaagcgattgcaaccatcagcatgtacaacatgggtacagccagccgcaacggactgaaacatgcgctgactctggaacaacggaaacaaatcatggctgaggcagcagaacagcgctatgcggaatttctgggcggagaaactaaatatactggcggcactgtacatgaaataacagaaaactctggtccgatagaacgcgaattttatgagttctaccgcactcagaggggagagtttactcccgaaggagcaaccctgacaactaccacacaccctacactttcaagcaacgtgaaattcatgaatttctatcctttcgaagatattgagactatttcgccccgtcctatgctttttataaccggagaaaatgcccactcacgcgaatttagtgaagatgcctaccgactggctgccgaccccaaagaactgtacattgtacccggtgcaggtcatgtagacctttacgaccgtgtggggcttataccatttgataaattggaatccttttttaaggaatatctgaagaaataagtatgaacaggaaaaacagataactatttaaataaaagacaatcgaatcatgaaacaaattaaaaatacacattacgaaggcgaacgtcctttgttcgcatcccacgggctttatttggaagaagtaaccattcatgccggtgaatcggcactgaaagagtgcagtgatatagaagcggtaaactgtcgtttcgagggaaaatatccgttttggcataatgacggttttgtagttaaaaattgcctttttaccgaaggagcacgtgccgcactctggtattccagaaatctgaagatgaaggatacattagtggaagcaccgaagatgtttcgcgaaatggacggagtcgaactcgaaaatgtacagttgcccaatgctttggaaacactctggtattgccggaatgtagaactgaacaatgtgaagatagataaaggagactatctctttatacatggggaagacatccgcatcaagaattttgtattgaatggcaattactccttccaatattgcaagaacgtagaaatccgccatgctgaaatccattcgaaggatgcattttggaatacggagaatgtgactgtatatgattctgtattggacggtgaatatttgggctggcattctaaaaacttacgtttagtgaattgtaagatctcgggcacgcagccactttgttatgcacacgacctgataatggaaaactgcacaatggcggatgatgccgatcttgctttcgaacacagtagtgtgaaggcaacgattaaaggcccggttcacagcgtgaagaatccccgtacgggaaacattgttgccgaaagtttcgggacaatcatcctggacgagaacctcaaagctccgggaaactgcgaattgaaactttgggacggactgacttgttttgattgaaatatatgaagtacaacttcgatgaaattgttccacgcagaggtacaaattcctataaatgggattctgccggagatgcggatgtattaccaatgtgggtagctgatatggatttccgtacagctccctctgtggtggaagcactgaaaaggcgggtggaacatggtatcttcggatatgtgcgtgtgcccgatgcttactatgaggcgataacaagatggtttgccggacgtcatggctggcagattgaaaaagaatggattatttatacgaccggagtagtaccggccctgtcagctgtcatcaaggcgctgacaactcccggtgataaagtaatcgtgcagacacctgtctataactgctttttctcctccatccgcaataacggatgcgaggttgttgcaaatccattgatttacatgaacggaacgtatcagatagactttatcgatttggaacggaaggcggctgacccgagtgtaaaagtcctgctattatgcaatccgcacaatcctgccggaagagtctggacaaagcaggaactgactcgcttgggagaaatctgtcttcggaataatatatgggtagtagcggacgagattcattgcgaacttgtctttccgggacacacctatatcccttttgcatctgtctcagaagagtttttgatgcattccgttacttgcacctcgcctagtaaagcctttaatttggcggggcttcagattgccaatattgtttctgctgatacggatatacgaatgcaaatagacaaggcaatcaatatcaatgaagtctgtgatgtaaatccgtttggcgttgaagccttgatagctgcttacaatgacggggaagaatggctggaagaacttaaccaatacctgtttgccaactaccattatttaagggcttactttgatgaatatcttcccgaatttccggtgctgccattggaaggtacctacttagtatgggtagattgctcggctttgaaacaatcgtcggaggatatagtgaaaactctgttggagaaggaaaagctttgggtaaacgaaggcaatctgtatggagaggctggcgaaaggtttatccgtattaacatcgcgtgtccgcgacagcggttgatagaaggattaaacagattgaggcgggcattgaaataataaaataattgtcagtttattaataggttccccttctcactccccgtaaatacaaataaaaagaagtgatatgaaaagtcagaatccctcaaagaggaatttgccgggtgttatcatcgcttatttcctcatttatgtagtctggggctccacctatttttttataggggtggctttgaaagatttttcaccttttctgctcggagcactgcggtttacgactgcagggctgatacttcttggaatctgttatttacggggagaacaaatctttaagaaaagcctggtaaagcgttctgccgttagcggtattgttctgttgtttgtagatatggctgtcgttatgctggcacagcgctatctgacaagtagcctcgttgctattatagcttcttctacggcactttggattttacttttggatgtccccatgtggcgtactaatttccgcaatccccttacgatagcaggcggagggattggcttcggcggagtagtaatgctttatgcggagcagctcaatgcagaatggttgcatccgcaaagtgagcgtggtatcttgctccttgttttcggatgtatatcctgggctttgggaacactgtatgccaagtaccgttcttcccgtgaggaagaagtgaatgcttttgcaggttctgcgtggcaaatgctttttgccagtgtgatgttctggatttgtgctgttgtgaacggagatgttcgggaagccgatttgagtacagtttcggtcacaagctggttctccttgctttatttgatttcttttggttctttactggcatattcggcgtatgtctggctcttgaaagtacgcccggcggcagaagtgggtacacatgcttatgtcaatccttttatagcagtccttttaggagtatcttttggaaatgagcaagttaccttcgttcagctttccggtttgctggtgattctgctgggggtgatgttgattagccggaaacgtaacaaaatgaaatcaacggcaatatcccgttaagcggaattgattcggcgtcatccccacaatccgtttgaacatccggctaaggtgctgcggatactggaatccgatttcgtaagcaatttggctcatagtcttgttcgaagacatgagttgttcttttgccagttcaatcattttatcctggatatattcggagacggttttaccggtttgtttgcgcaccatatcgccaaaatagttagcggaaaggaatactttatcagcgaagtacttgaccgatggcaacccttggttttgcggggcatctccttcgaaatattcgttgagcagatgttcgaagcggacaatgatgtctttgtttactccgtttcgtgtgtcgaactggcgttcgtaaaagcgcatacagtagtcgagcagcaatcctatgttggcgcagattagtcggcggctgtgtttgtcgatggaatgttccagttcgatggtgattttttgcaggcagtccatcactgtttgccgctcttcttcggaaatgtggagtgcttcgttggtttcgtaggagaagaaggagtatttctttatttcttgtccgagcgcagtgccacgtataaggtcgggatgaaaaagaataccatgcgcgttgggttgaatatttggcagcatttccaggtcggtgatttgtccgggagcgaaacagacaatggttccgtcttgatagtcgtaatattggcgcccatatttaatatcaccacattttacatttttcaagtatagtgcatatacttcgtaacgaaaccacgcacgtgtgggccacgtagtggatttggccagatcgatgatgctgactaacggatgtctggtttcaagcccgaagatttcgttgtaacggtcaacgctgtctattacaatcatttctttagtattctcttccatatcacaatctgtttttttaatgcgttacaaatataattcttttctctttaaaatttttactctcccatcaaaatccatgattggggtataaatatccgtaaatcgtctacatccgggctggaccattccccgtaactttgtaaccggtaatttaacattgaaaagagatagtaatatgaaaaagattctattaattccattgatgatgctgacgatgatgccgatggcggcttgcgacggctcaaacgctgatccgattcttccggaacagccgggacaaccgggaaattccgacggtggagacgaggacgattctacaaacccgacaaaccccattccgggcggtaacgggcgatatctggtactttactgttcgcgcaccggcagcacggagcgtatggcgcaacagattcagcaaacactcgattgcgatatcctggaagtggaaccgcaaacaccttatgaaagcgattataatgggatgctcaaccgtgcacaggaagaactggctgctatccgtcaggggaattatccggcgattaaaacttcggttgaagatttcggcaactatgatatcgtgtttgtcggctatccgatttggtacggtagcatggccacaccgatgcagacattcctgcataatcatgcttcgaaacttgcaggtaagcgtatcgctctttttgccagcagtggcagcagcggcatctctgcatcagttgacgaggcgcggacactttgctccggtgccactttcaccgaaacattgcttctgacttcttcgacactttcgcagatgggaaaccggatacggacatggctcgaaacactcggtgcgagtcgggaaaacaattatccgtctacttctacgaatgtgaagattacagtcggtaaccgtaccattactgctacgatggaagacaatgccgcggcgcaggactttctttcacgtctgccgcttgaagtgacgctgaatgattataataatatcacagagaaaattttctatccgtcgcctgcactgactacggcaggagtgccccgtggctgtgcacctgtgcccggtgatattacaatctatgtgccgtggaataatgtggcgatcttctgtaaaagcgggtcgcaaagcaatgacttgataaagattgggcgcattgacggtaacggaatagatgcattgaacgttccgggcaatgtggcagtgaaattcgaacgacaataaattagcaaaatgaagaagttactgattatttttctattgtttgcagcaaccgcttcggcaaacgtaatcagaccggtcgaaccatccgccgccgagaacaatatggtgcggttgtcacgcatcataatcgatccggaacggctggaagagtacaatgcttatctgaaagaggagatcgaagtctcgatgcggttggaaccgggcgtattggtactgtatgccgtagcggagaaagaacgccccaaccacgtgactattcttgaaatctatgccgatgaagcggcctataagagtcatattgccacacctcattttaagaagtacaaagaaggtacacttgatatggtgcagatgctcgaactgattgatgctacgccactcattcccggactgaagatgaagtaaatgataggcagtactataaatctgtaattttggtttttatatccgtaatttgtattataaagagttggatcagaacagctaactttgcattatcagagagttcttaaataataaaccatggacgtcacagtatgagaaaattattttttatttttgtaacagtcatcggatttctgcaaattccgatgcaatctataaatgcacagagtatgaagaaagaagaagtacctcagaacatcagcgcatttccgttgggaaaggaaaatacgggattcaagcaatattttacaggagaatcctggctggcaccgctgaccggtaataaagacttgaatgtacccatgtccaacgttacttttgaacccggctgccgaaataactggcacagccatacgggcggacaaatcctcattgctgtcgggggtgtggggtattatcaggaacgtggcaaagcggcacgccgcctgctccccggtgatgtggttgaaatagcaccggacatagaacattggcacggtgccgcccccgatagttggttttcgcatctggctatcggctgcaatccgcagaccaacaagaatatttggctggaacaggtagacgaccagcagtatgccgaagctacgaaagataacggaggaaccggattaagcgccaccgaccccgaactggatgcaatattcggcaatttcacaaaggaggtgcagcaatacggcaacctggatactaaaacccggctcatggtaacattggcatccaatattgcctcacaggcacagaccgaataccggatgatgcttgaaagcgctctcaatgcaggtattactccgatagaaataaaggaaatcctttaccaggcagtagcctatgcaggcatggctaaagtgatggactttgtcggcatcactaatgaggcgctgcttgcccacggtgtacgtcttcctttagagggacaagcggtcgtttctgccgaaacccgtttcgacaaaggactggcgttgcagaaatccattttcggcgaacggatcgaccaaatgcataaaaatgctcccgaaaaccaaaagcatatccagcgttatttctccgccaactgcttcggagactaccagacacgcggtggactggacgtgaagacacgggaactactgacgttctccatccttgtttccttgggaggctgtgaatcacaggtgaaagggcacatacagggaaatgtcaatgtaggtaataataaagatactttgctggctgtcgtgacgcagcttttgccttacatcggctatccacgtactctcaacgctatagcctgcctgaatgaagtgattccggaaaaataacaaagacgttcatattcccggaaagcaggcggttaaaatctgtttgggacttgacaaatgcttttttatgttgtatatttgtagttcgggaaagtatgaaaccaatgaataatgaatgaaaaaatagataaaatatgagtgtaaaacgaatgataaatggtataatattaggactaatataacatatttctttagctcgttctagagatcagaaggataaatatagagcaaaggttgcaaactttatggagtttgcaaccttttttgttgcataattttaattcatttcccatgattttttatttttgagtttataataaacgaaggggacgtttataataaacggtcacagaatttataataaacgtgatctatgtttatgtagtaacttgttcccttttttcgtatcttctttccttgaagaacagaaatccacgtacttatggtaataatagctgatgttatgcttaagtaatttttctatgcatatctcccgtttgtcgggaacttcgtagagcaggataataaaaccgttgtcggataaccgattcactgtaagatttgttatccttacaaaggactcacttattaaagagaagaaattatggatatcattgaccgtttgaaaggccttcgccgcaatcttcctatcggaatacagagttttgaaagacttcgtcgtgacggttatttatatgttgataaaacagcatttgtctacgaactagcctccacgggcaatccgtatttcctgagtcgcccgcgtcgttttggcaaaagtttgttgctttccacactggaagcgtatttttgtggaaagaaagaactttttgaaggactagccatcgagcagtatgaaactgaatggaacgagcatgctgtactgcatcttaatttcaattttaatgctgaggattactctgatattgaaggactgaaaaatggacttgaattgtaactatgtagttgggagggctgatggatgccgcatggtgaaaataggcgcggagttcagcaaggaagaacgcaacgtgagtcgctggctggtggaggaaggataaatatgatgtatgttccatttttaataattgcattggcctcgatgagtataaattccatcaaatagagaaaaaagtgcatagaataatgaaataatatgcagctttcggacatatttctgcatctaaataatcattatatgcattataacaagcaatggtaagcgtctttcctttaaatgaaaccctgccttggttttaaaccaacggaccgttggtcggtgagggagcgttcatttctttaaaagaatggagtaaaacctctttttgagtgctactttgtgctggaaacctcttttttatggataagtttaaactgttaatatgaaatccatttttcgtatctactgttcttcgtgaatgaaattatgaccggactgcatcttattgctgcatcatgacccttattgtttttctttcgataattgctgatggaaattgcagccgattttatttttgtacctctgctttcactgcatattctgtgttattagcttgtatgatgttcattatctcatctataggtctatttttaatattcctaagaaacaaaatagatgttaattcgcctcttgctccgtgaactaataattcatattgtatgttgtttaaagtgaataacgaaataaatgatgaactaaaaagttaggcatgagcaaataaaacatttctaatgatttagcaaatgaaacattacaatttaaaacgtatgattatgaagaaatctattattctattagctatggtattgggcgcatttacagcaaaagcccaatctgttgtagaaggtacaaagtttgcagataattggtctgtagaagtaaatgcaggtgcaatcactcctctcactcacagcgctttctttaagaatgcacgtccggctttcggagttggtctttccaaacagttgactcctgtcttcggtttaggatttcagggtatggggtatatcaataccactccaagtaaaacagcttttgatgcctcagatgtcagcctgttgggtaaagtgaatctgatgaacctgtttgctggttacaacggcactcctcgtttgtttgaagtggaggcagtagccggtgcgggatggttacattattatgtgaatggtgatggcgaccagaactcatggtcaacccgtttcggattgaatctgaactttaatctaggcgaaagcaaggcctggacattgggactgaaacctgccatcgtatatgatatgcaaggggactttaatcaggcaaagagccgtttcaatgccaataatgcagcatttgaactgactgccggactgacttatcacttcaagagcagtacaggaaaccgttacttcaccgaagtaagagtttacaatcagggtgaaatcgacgatttgaatgcttctatcaatgctctccgcggacaagtgaacaataaggacggcgaactcaacagcgccaaccaaaaaatcagcggattgcagcaagaactggaagaatgccgtaccaaggtcgttccggtggagactgtagtgaaaactgcccgtgttcctgaatctatcattactttcagacagggtaaatcatcggttgatgcttcacagttgccgaatgtggaacgcgtagcttcttatctgaagaaatatgctgatgcaaaagtagtcatcaaggggtatgcttctccggaaggtagtgctgaagtcaatgcaagaattgccgctgcacgtgcggaagccgtaaagactattctggtcaataaatacaagatcaatgcttctcgtatcactgccgaaggtcagggcgtaggtgacatgtttaccgaaccggattggaatcgtgtaagtatatgtacgattgaagactaaaaacaagagatgtaaatagaatggtgagggctgctccgtaaaagggcagcccttgctgtatatattcatttatgcccttctgtttgtgaataagtaatagtaatatctgtcgtccagacaggaggtgatagcagaaaatcgggcaaagtcattgtttgtctgtctaaagtgactacttttggcaaaccatactattaaggtatggccgaagatgatgaaagagcagaatataccccaagacagtttgatagccggctatcttccggcagattattgcgattctttttcaaggaacgtagtcagtgaaaaagcaatcacttccgacgagttctttgatatggcttttaatcactctccgggctgggtgaatgggttgatgaagttaaggaatgcgatagtcaaaccgttaggtctggaagttggtatgcgctttgccgatacgatatgtgagcagaatgcacaggaagttgttttcggtatgcccgataaacacctgacgtttcatgcttcattatggtgtggagagaaggagcccggcgggcagacgtttacaatcacgaccgttgtaaagttcaataaccgactgggccggttgtacttcttctttattcgtccttttcataaagtcatcatccgttctatgctgaaaagggtagcaaaacgattgaaataaaacagcttatggatataaatgatatcatagactctatttacaagttgccggatgcctcaaaggaggctttactgagtgatgctcccgaagtagcctatcctaaaggcttccatctgttccgggcaaatcataaaaactctaagttctatctgatgaagaaagggatgctgcatgcctatacctatcagtcggataagaaggttaccttctggttcgggaaagaaggggatgcaatcttccctctgcaaactcttcatgataatcgggcaggatatgagaatattgaacttttggaagacagtgtcctgtatgaactcagtgtcgataaattgcacaatctctatctggaagatatacatatagccaactggggacggaagttttccgagagagaatgcatcaaatcggaaaagttgtttatatcaaggcaattcaaaacttcattggagaggtatcaggaactgatatccgaatatcccgatatacttcaacgtgtgccattgggtattatagcttcctatttaggcatctcacaggtcaatctaagcagaatccgtgcgaagataagatgattttttaaactttgtaaaatcccttttttacaaatgtaaaatgaagggcgccggaaattcatgacctttgcaatcaaaaaaaagaagtgttatgaattggattcttttgattttggcaggatgccttgaattggtctttactttctgtctgggaaaaataaacagagtagtaggagcagagaaatatatgtggtcattcggactgctgatatccctgtgtgtcagtatgctccttctgataagggttaccaaagcattgcccgttggtacggcttatgctatatggaccggtatcggtgccgccggtacggtgctgatcggtatctttttctttaaagagccggcaagctggggcagaattttcttcatcttcacattgatttgctccattgtaggtctgaaattggtatcacattgataccttatggtatcataaaaaaataattatcgattataatttggtagttatgaaaacaaagcccatatttgcaccccaaaaatagggacaggcatagaaaatcctcatcggagggtgctataatagataattatagtgctggataagatgaatggtgtgaatcattcagcttgtccggcacttttttattttgtaacaagtaagataagaggagtaagtattgaaaaactatgaaggagttaaatttgacacaagggagtgttccgaaagtattactgcaatttgcggttccttttctgattgccaatgtgcttcaggcactttatggcggggccgacctttttgtggtgggacaatacgatgattctgcaagtgtggcggctgtagccatcggcagtcaggtgatgcagacaatcacggggattattcttggcattacgacaggaacaaccgttttgattgccatcgctaccggagcaaaggatgacaagaaagtagctttcaccatcggttcgtctgtatggttgttttcaataatcggggtgctgcttactttggtcatggtggtttttcatggtcggatagcagagttaatgcatacgccgatagaggcgatggcggatacgaaaagttacatccttgtatgttcggccgggatattgtttatagtaggatataacgtcgtatgcggtattttgcgcgggttgggagactccaagacgccgctttattttgtagcgctggcgtgtgtgattaatattgtactcgattttatactggtaggatatttccatttgggagccacaggagcggcagttgccaccataacggcgcagggagtcagcttcatgatctctctttggttcttatatcggcacggatttcattttgagtttacccggaaagatatccggctgaaccggaacctggccaagaaagtcatgacattgggagcgcctattgcgttgcaggatgcgctgatcaatatctcgtttctgatcatcaccgttatagtcaatcagatgggagtgatcgcatcggcttctttgggtgtcgtagagaaaattatagtgtttgccatgctgcctccgatggcaatctcatcggcagtagcgacgatgacggcacagaactacggagccggacttatacaacggatgaaccgctgtctggcttcggggataggaattgcatttgttttcggtgtatcggtttgtgtgtattcacaattcctgccggaaacgcttaccgcgttctttaccaaagatgcggcggtggtatcaatggcggcggagtatctgcggggatatagtatcgactgtatcgttgtaagttttgtgttctgtataaactcttacttcagcggacagggaaattcattgttcccgatgattcacagtctgatagcgactttcctgttccggattccgttgtcgtactggtttagtcagatagacagttcttccttgtttatcatgggctttgcaccacctctttcaacagtggtttcattgttgatctgtatctggtatttaagatatacccggaagaaagtttatttgaaaggcaccatgatgcctgctatgtcgaattaggtgttttaagtggatatattaactaaaatcaatttgtatggaagcttatttgaagaaactctgttttgagtatcaggttgaagaaaaggaagtgaaagagctgttggctcgcatggaaagagtgtatctggataaaggagaaacgattgcttctgctacaatgcccgagcagagcttgtacattatcgtttccggtatcctgcatacatttactacccagcagggagaggacaaaaccgtcagattcctgtccgaaggtgacgctatattgtgctacaatacaagtaagcattctgtcaaaacactgacaaggtgtgtggcctattacatcagcgaagatgagatcgaggaattgtgtgcaacgtccatcacgttttccaatctgattcgtcagatgatggaatatcagttttaccttaaagaggaaatgagtgtgaatgcacgtaaactgacgatcagggaaagatacctttctttattatcagaaattcccgatattctgtacagagtccctttgaagtacattacttattatttaggggccgatgtgacaagtctgggatatctggccggaagctgtaaataagaaatgtctcattctctatatttgaagatattccttgttgaatagtctattcttaccccggtgcttctcaaaaccggaaagtctttggatcatttgataaggaatattatttttgtaattgaaatgaaaaatctgattccccgatatactttctataagaataagtatggaagtgaacttttgatagatgtcgtcgaactgaaatacgtaaagaagttcctctctcagagttctgtccacacgctgacttactatgatatcacgtttgtcacagaaggggagggcaagttttcgatagataatcagactaacgaggcggcttcccgtgatgtgtttttctctaaaccgggagagattcggaactgggatacccgccacatagtcaatggttatgctttgatctttgaagatgagtttttatcttctctttttaaggattctctctttgtgcagcatctttcattcttccagtcgggaaagacatcatccaaattacagttgccggatgaactttatatgcgtatccttcagatattgcacaatattaaaacggagattgattcgtacagacagaatgatgtgtatgtattaagggcattactttatgaagtcctgatgttgttggaccgggaatataagaaagtgaatatggaagaagaaactacatccaaagaggttggtaatatccatattgacaaatttatgaagttggttgagagccatctgaaagagcagcattctgttcaatattatgcggataaactttgtattaccccgaattatctgaatgagattgtaacctctacaaaagggattagtgcgaagcaatatatccggaataaagtaatggatgaggctaagagactgcttacttatacagatttccctatatcggatattgcgtttgaacttcatttctcaactgtctcttattttatccgtagcttccggcaatatactggaacaacgccattactttatcgaagaacgcataaaccgtaaaaagtgatatttctccctttctttctgttgcactgattgtcttctatatccctactttcgcatcagataataaccaattaaaattattgaacgatgagagatgcggaaaaaacagtagggaacatgattgataagctgaaaacggcctttatcggttccatagacagtgaaggatttcctaatatgaaagctatgttacaaccccgaaagagggaagggataaagacgatttatctgactacaaatacttcgtcaatgcgtgtggcccaatatcgtgagaacaatcatgcctgtatttacttttgtgatacgcggttctttagaggggtgatgctgcgcggtactatggaagtgctgaccgatcctgccagtaaagagatgatatggcaggaaggggatacgatgtactatcccgaaggagtgacggaccccgattattgtgttttaaaatttacagcgatttccggaaggttttacagtaactttaagtcggaaagtttcgctgttgaatagaatcagtaataatggttgaacaacccgtaatttatctactgtcagatgtatgtttcttccttaattttgtactgtaataaaatcaattcaactattgatcttgttattgataagtatggaggtattgagtttaataattaaaatagtgcatttatggaaacagtaagattgaacaacggtgttgaaatgccgattttaggctatggtgtatatcaggtaactcctgaagagtgtgagcgctgtgtgctggatgctattagtgtcggttatcgttctattgatactgcacaggcatattataatgaagaaggagtgggtaatgcagtcaggaaatgcggtgtaccacgtgaagaactgtttatcacaacgaaagtatggatttcgaacggtggatacgaaaaagcaaaagcttctattgacgaatccttgcgtaagctccaaagtgattatgttgatttgttgcttattcatcagcctttcaatgattactatggtacataccgtgccatggaagaggcttacaaggccggaaaagctcgtgccattggtgtcagcaatttctatccggaccgtttcattgatctggcagaattttgtgagattaaaccggcggtgaatcaagttgaaacacacgtcttcaaccagcaagtgaaaccgcaggagattatgaagaaatacgatacgaaggtcatgtcatgggggccatttgcagaaggacgcaataatttcttctctaatgaagtattgaaagcaatcggagaacagtatggaaaatcggttgcacaggtagctctgcgctttcttattcagcgtgatatcatcgttatcccgaaatcgactcgcaaggaacgcatgatagaaaacttcgatgtatttgacttcaccttgtccgtaaaggatatggaagagattgccggactcgataaaaaagaaagtctgttcttctcccattatgaccctgaaatggttaactttctgattaatttataatagagggaatatgtaggcggaagatgtttagaaaagaatcgtcaggaaagattaatctcttctgacgattcggaatattggaacgtagcgaaaaatggaactttattatcccgatgttctccgtatgttttgtctatttgggtatgaggctatttttatatctaatgttagttatccggtaattgttaaacttaaccttgcttttattactccggacagaatccgtttttataaaacagataacttttttctattgcttcggctgtatcagcttctaatgcatatagtatttccctgcaaaattccagttgtccggttccgttagcggttatgatctttccatctcttacagcttgctgatcaacgtagttcgaatcacctgtatatctctctccgacatgttgtttcagataatcgattgtattactcgtatgctttacgttattgagaaatccatgcatagcaaggaaaacggaagcattgcatattccgccaaccactttcttatctttgatagctttttctaccagcgggactattaattcagcttctggtgaaaaccagctcatgccgccaattaatatcagacctgcataatcttccggcatatctttcaaatcataatcaggcaatactctgaatccccctattgaagagacaggctctttggttatagacaaggttttcactttataaggaacaggacttccgggcataacaccctgatttagacaggcagctataaatgcgccttcccagtcggcgaactcatttaataatacaaaaattacttctttcatatatcattctattttctttatgtatgcaaaggtgctatttaaaattgaataacccagatgatgcagtgaattattatcttttttatatatgactttataggtctgatgtccgatggcgggtaacagaatgtttaagatatccgtcagtcttagtcgtagactgtagctgttagcgatcttggtttcgtgtaatgcataaaaaaaaagtctttgattatcaatgtaatcaaagacttttttactttcttaagaagcggtgcgtacgggactcgaacccgtgaccccatgcgtgacaggcatgtattctaaccaactgaactaacgcaccaaatattaaagactaattcattttatttctctttgcttcttacttaaaagaagcggtccggacgggactcgaacccgcgaccccatgcgtgacaggcatgtattctaaccaactgaactaccgaaccagaatttcattttgttaatctgcatctctctcgattgcgggtgcaaaggtagttgttttttgtaaatctgcaaatgttttgatgaaacttttttccaataaaaagcaagaaaaaagcttagtgtctcattttgagtacttttataatgaaaaaaaatattagttttttcttcagtcaggatggtgacactatccggtcgtcatagtgacactatcacgatgggatagtgtcattatccggaggcgatagtgtcactatcctgaagtttgtcatcttcttctttggaaatagtcttggatatctttctatctgtaagaaatcaccgtttttatatcaactttctgcttgaataattcgtagttttgcaataaatcgttatttttgcgcactaaaattagataggtggaagaatttccgcccggaatagtaaattagtaaaaagaatgatgactacagccaaactgttattgcactgtcccgacaaaccgggaatcctcgcggaagtgacagactttattacggtaaacaaaggaaatattatctatctggatcagtatgtagaccatgtggagaacatcttcttcatgcgtatagaatgggaattgaaagattttctggttccgcaggaaaagattgaagattatttcagaacgctatatgggcagaagtatgaaatggatttccgtctttatttctcggatgtgaaaccgcgtatggctatattcgtttctaaaatgtctcattgcctgttcgatatgttggctcgctacacggcaggagagtggaacgtggagatacctcttattataagcaaccatccggacttgcagcacgtggcagagcgtttcggtattcctttctatttgttccccatcaccaaggagaccaaagaagaacaggaacgcaaagaaatggaattgcttgccaaacataaaattacattcatcgtgttggcacgttatatgcaagtgatttccgaacagatgatcaatgcgtatccaaataagattatcaatatccatcattccttcctaccggcatttgtgggggcaaaaccttatcatgccgcattccagcgtggagtgaaaattatcggtgcgaccagccattatgtgacgactgagctggatgcaggtccgatcatcgagcaggatgtagtacgcattacacataaggactctatagaagatcttgtaaataaaggaaaggacctggaaaaaattgttctttcgcgtgcggtacaaaagcatatcgaacgtaagattttggcttataaaaataaaacagtaatatttagctgatgaaagtagcagttgtaaaatacaatgccgggaatatccgttctgtggactatgctctgaagcggttgggagtagaagcagtgattactgccgataaagaaatacttcaatctgccgataaagtgattttccccggagtaggagaggcgggaactaccatgaatcacctgaaagcaacagggctcgacgagctgatcaagaatctgcgtcagcctgtgttcggaatttgcctcggtatgcagctgatgtgccgacattctgaagaaggtgaggtggactgcctgaatatctttgatgtagacgtgaaacgttttgttccgcagaagcatgaagataaagtgccgcatatgggctggaatacgattggtaagacaaacagcaaactgttcgaaggattcaccgaagaagagtttgtctactttgtacacagtttctatgtgccggtttgtgactttactgctgctgaaaccgattatatccatccgttcagcgcggcattgcataaagataacttttatgccacccagttccatccggagaaaagcgggaagacaggtgaaagggttctgaggaactttctggatctctaataaacgttgcaacagtttataataaactccgctatagtttataataaactcggtcatcgtttattataaactatttccggcttttcggagaagaagaaaaggacaggtataagaagatggagtgaacagctaaaatagtaaatcgtaaatgatcaaattgtatataaacagatgatagaaattattccagccattgatattattgacgggaaatgtgtacgcctttctcagggagattacgatagtaagaaggtctataacgaaaatccggtggaagtagccaaggagtttgaagcgaacggggttcgcaggcttcatgtggtagatctggacggagccgcttctcaccacgtagtcaaccatcgggtattggagcagattgctacgcgtacctctttaatagtagattttggcggtggagtaaagagtgacgaagatttgaaaatagcttttgaaagcggtgctcagatggtgacaggcggaagcgttgccgtgaaagatccggagctgttctgccattggctggaagtatatggcagtgagaaaataatcctcggagcagacgtcaaggaacataagattgctgtaaacggctggaaagacgaaagcgcctgtgagcttttcccatttctcgaagactatataaataaaggtattcagaaagttatttgtactgatattagttgtgatggaatgctgaaaggtccttctatagatttgtataaagaaatgctggagaagtttccgaatctctacctgatggctagtggcggagtgagcaatgtggatgacataatcgccttgaatgaagccggagttcccggagtcatcttcggtaaagcattgtacgaagggcatataacgttgaaagatttgcgtatatttttataatcaggagtgctaaaatgaaaggaagaaccctgttataatgaaaaataaggaagcaggttctcggattagtagaatctaaattgtcaaatagtaaataagatagaattgtgttagcaaaaagaatcataccctgtctggatataaaagacggacagaccgtaaaaggaacgaactttgtcaatttgcgccaggccggtgatccggtagagctggggcgggcttacagcgaacaaggagcagatgaacttgtgtttctggatattaccgcaagtcatgaaggacgtaagactttcacggaactggtaaagcggattgctgccaatatcaatatcccgtttaccgtgggcggtggcatcaatgaattgagcgatgtagatcgcctgctgaatgccggagcggataagatctcgatcaattcttccgccattcgcaaccctcagctgattgatgacattgccaagaacttcggttctcaggtttgtgttctggcagtagatgccaagcaaacagaaaacggctggaagtgttatctgaacggcgggcgtatcgaaaccgataaagaattgctggcatggaccaaagaggctcaggagcgtggagcaggcgaaatcctgtttacgagcatgaaccatgatggggtgaagaccggttatgcgaacgaagcgcttgcttccttggccgatcaactctctattcccgtgatcgcttcgggcggggcagggctgaaagaacacttccgtgatgcttttttagtaggaaaagcagatgcggcgttggctgccagcgtttttcatttcggagaaattaaaattcccgaattaaaatcgtatctttgcggcgaaggaataaccatcagagggtgaggcggcatgggctcacacaaacggtatagtaaattgaaatagtaattagaacttaatataagatggaattggatttcgataagatgaacggacttgttccggctatcatacaggacaacgagacacgcaaagtcttgatgctgggctttatgaataaggaagcctatgataaaacggtggaaaccggaaaagtaactttcttcagccgtaccaaaaatcgtctttggacgaaaggagaagaaagcggcaacttccttcatgtggtatctatcaaagcggattgtgacaacgataccctgttgatccaggcagatccggcaggtcctgtttgtcatacaggcacagatacttgctggggtgagaaaaacgaagaaccggttatgttcctgaaagcattgcaggatttcattgacaaacgtcacgaagaaatgccccaaggttcttacaccaccagcctgttcgaatccggaatcaacaagatcgctcagaaagtaggtgaggaagctgtcgaaacagtgatcgaagctacgaatggaacaaacgaacgtctgatctatgaaggagccgacctgatttatcacatgattgtattattaacttcaaaaggctatcggatcgaagaccttgcacgcgaattgcaggaaagacatagcagtacatggaagaagcattaattcaatataaaaacgtagaaatccatcaacaggaactctgtgtactgagcgatgtcaatctggaattgcacaaaggagagttcgtctatctgatcgggaaggtaggttcggggaaaacgagcctgctcaaaaccttttacggcgaactggacgtaatcgacggcgaagcggaagtgctgggctataatatgcgttcaatcaaacgcaagcatatccctcagttgagaagaaagctgggaattgtgtttcaggactttcagctgctgacggaccgtaccgtttacaacaatctggaatttgtgcttcgtgccactggctggaagaacaaacgggaaattcaggaaagaatagaggaagtgctcgacctcgtgggaatgtccaacaagggctataaactccccaacgaactttccggcggcgaacagcaacgcatcgttatcgcacgtgccgtgctcaattctccggctattatcctggcagacgagccgaccggaaatctggatgtggaaacaggcaagtccatcgttgaattgttgcacaacatctgcgaatccggttcgtcggtagtgatgacaacgcacaatctgcaattgctgaaagaatatcccggcagtgtataccgctgttccgaacatcgtataacggatgtgacagacgaatacatgcccagacagagaacaatagaaatagatttaaatatagataactaaaacagtaacgaaaatgaaagttttaaagtttggaggaacttccgtgggttctgctcagcggatgaaggaagtagccaaattgattaccgatggtgaacagaagattgttgtcctttctgcaatgtcaggaacaacaaatacattggtggaaatttcggactatctgtataagaagaatccggagggtgccaacgagattatcaataagctggaatcaaaatataaacagcacgttgatgagctttttgcaactcaggaatataaacagaaaggtttggaagtcatcaagtctcacttcgactacatccgctcctatactaaagaccttttcactttgttcgaagagaaagtggttttggcacagggagagcttatttctacggctatggtcaacttctacctgcaggaatgcggtgtgaagtccgtattgcttccggctttggaattcatgcgtactgacaagaacgcggaaccggaccctgtatatattaaggagaaactgcagacacaactggaactgtatccggatatggagatttacatcacacaaggtttcatctgccgcaatgcttacggtgagatagacaacctgcagcgtggtggcagcgattacaccgcatccttgatcggtgctgccgtaaaggcttccgaaatccagatatggacggacatcgacggtatgcacaataacgacccgcgcattgtggacaagacagcgccggttcgtcagctgcatttcgaagaagcagccgagctggcttacttcggtgcaaaaatcctgcacccgacttgcatccagcctgctaaatatgccaatatacctgtacgtctgctgaatacaatggacccggatgctcccggaacactaatttctaatgacacggagaaaggtaagattaaagccgtagctgccaaaaacaatattacagctatcaagatcaaatcaagccgtatgttgcttgctcatggtttcctgcgtaaagtattcgagatctttgaaagctatcagacttctattgacatgatctgtacttcagaggtcggtgtatctgttacaatagacaacaccaagcatctgaacgagattctggacgacctgaaaaaatacggtactgtcactgttgacaaggatatgtgtattatctgtgtagtaggtgacctggaatgggagaatgtcggtttcgaagctaaagcgcttgatgcgatgcgggatatacctgtacgaatgatttcctttggaggaagtaactacaacatttccttccttatccgggattgcgataagaagacggcgttgcagtcgctgagcgatatgcttttcaacaacaaataattccacaaataatacgagcgcttttattgatactgataaaagcgctctttttaactaactaaacaagtttcttgaattatgaaaggaatatttccaatcgataaattccgtactttgcagacacctttctattattatgatacgaaagtgctgcgtgatacattgtcggctattaaccaagaggttgccaaatatcctagctattccgtacattatgccgtgaaggcgaatgccaatccgaaagtacttaccattatccgtgaaagcggaatgggagcagactgcgtgagtggcggagaaatccgtgccgctgtccgtgccggattccctgccaataaaatcgtttttgccggagtcgggaaagcggattgggagatcaacctcggactggaatatggcatcttctgtttcaatgtagagtctatccccgaactggaagtcatcaacgaactggctgccgctcaaaataagatcgctaatgtcgctttccgtatcaatccggatgtcggggcgcatacgcacgccaatatcaccaccggtctggctgaaaacaaattcggtatcagtatgcaggacatggacagggtgatcgatgtggctttggaaatgaagaatgtaaaattcatcggtctgcacttccatatcggttcacagatattggatatgggcgatttcatcgctctttgtaaccgggtgaatgaattgcaggacaagctcgaagcccgccgtattctggtagagcatatcaatgtcggtggtggtctgggcattgactacggtcatccgaaccgccagtccgttccggacttcaaaagctactttgctacctatgccggacagctgaaactgcgtccttatcagacattgcacttcgaactgggacgtgcggtggtaggacagtgcggctctctgatatcgaaagtgctgtatgtaaagcagggaacgaagaagaaatttgccatcctcgatgcaggtatgacagacctgattcgtccggctttgtatcaggcttaccacaagatggaaaacattacttcggaagaacctgtagaggcttatgacgtagtaggtccgatctgtgaatcatcagacgttttcggtaaagcgattgacctgaacaaagtgaagcggggggacctgattgcacttcgttccgcaggtgcctacggtgagattatggcatccggatacaactgccgtgaactgccgaaaggatacacttcggacgagctggtgtaaataaaatgtgaatgtagtttaaaaatgcagggagcttggaacaattttaactgaaatcttgttatttttgtaatgagttcaaaagaaaactacattaacaacttaataaaaatatacgattatgatttcagaaaaattacagaaagcaatcaatgagcagatcactgctgaaatgtggtcttctaacctgtatctggcaatgtctttctactttgagaaagaaggtttcagtggctttgcacattggatgaagaaacaatctcaggaagaaatgggacatgcttatgcaatggccgattacatcatcaaacgtggcggaactgctatagttgacaagattgatgtggttcccaatggctggggtactccgctggaagtgtttgaacacgtttacaaacacgaatgccatgtatctgcattggtagacaagctggtagatgtggctgctgctgaaaaagataaagctactcaggacttcttgtggggatttgtccgcgaacaggtagaagaagaagctactgcacagggaattgtggataaaatcaagaaagctggtgataccggtattttctttgttgattcacaactgggacaacgctgataatgatctgaaaaatagaaaattatataagagaagctgtttgggtttatattcagacagcttctttttttatcttacttatcaacttccctgccgggctatttctttatctttcctttttccatagctcccagataaatctccagcgagcgggtagaaatctgtatttcgcggaaggatacacccaaagaagcgattaacagtatcaatgccagtccgaatacataaaccgataacaactgcagtccgatgtaaataagaaacatactgactacacagaaaaagaggcttgctatccccagtccctgcatcgtgcgtgtcagattcaaccgtttcctcaaattctcgatttgtgctaccgtgatatccgtaggattttccatatagcggtcccgcaactgtcgcaccagctgcgcatacgataaaaaacgattggtataagccagcaaaatcagcgaaacagccgaaaaaagcaaagcaggagtagtgagcgtaagttcttccatcttgaaaaataggtaataggtaataaataataggtaataagtaataggtaataagtaataagtcatgcgggtaaagctaccggcagctacgattattacctattacctattacttattacttatttcaaggttcctagttctttgccaaccttaataaaagcagcgatacatttgtcgaggtgtgctttctcgtgtccggcagagatttgtacacggatacgtgcctgttctttcggaacgaccggataatagaatcccgtcacataaatgccttcttcctgcatgcgtgcggcataaatctgagagagtttggcatcatacaacataacggcgcagatggcactttgtgtcggtttgatgtcaaatccggcagctgtcatttggtcacggaaatagtttacattctctaccagcttgtcatgcagcgcattgctttctttcagcatcttgaatacttcgagacttgcaccgatgatacccggagccaacgagttggagaacagataaggacggctgcgctgacgcagtaagtcgatgatctccttgcggccggtggtaaatcctcccaatgcgcctccgaaagccttgcccagtgttcccgtatagatgtctacgcgtccgtaagtcttgtacagttcgctgacaccgtggcccgtagcgccaaccacaccggcagagtgcgattcgtccaccattacgagtgcatcatatttctcggccaggtcacagatctgatccataggtgctacatttccgtccatagagaatacaccgtcggtaacaacgatacggaaacgttgtgcctgagcttcttgcaagcatctttccagatccttcatatccgcgttggcatagcgatagcgtttcgctttgcaaagacgtacgccgtcgatgatagaagcatggttcagagagtccgagatgatggcgtcttcttcgctgaaaagcggttcgaacacacctccgttggcatcgaaacaggctgcatacagaatggtgtcttctgtctggaaataatccgagatagcagcttccagttccttatgtatatcttgcgttccgcagatgaagcggacagatgacataccaaatccacggcgctccatcatttcttgagaagctttaatcagacgggggtgattggacagtcccagatagttgttggcgcagaaattcagcacttcttttccttttacagtgatggcagcttgctgcgcactttcgatcagtcgttcttctttgtaaagtccggcttccttaatttcagccagtgtctggctgaggtgttctttcattttaccgtacataatgtttgagtgattaagttaatggtgcaaaggacacgatttttcttggaataaacaatatctttttgatttaaatctgaaaaaaaagtgcttactttgcgcactatttagcttaacacttttatttaaaaggaaaaatgaaacacattttgattattggagccaccggacaaataggatccgagttgacgatggagttacgcaggcgttatggaaacacaaacgtagtagcaggttacatccagggtgcagagcccaaaggagagttaaaagagtcgggaccgtcggcagttgtcgatgtaacgaatggtgaaatgattgaatcggtggtgaaggaataccacattgataccatatataatttggctgcactgctatcggtggtggctgagtccaagccgaagctagcctggaaaattggtattgacggactgtggaatgttttggaagtggcgcgtgagcagggatgtgcggtatttacccccagttctatcggatcgttcggtgcaagcacgcctcatacacagacaccacaggatactatccagcgtccccgtactatgtatggagtcaccaaggtaacgacagagttgctgagtgactactattttaacaaatacggtgttgacacacgtgctgtccgtttcccgggcatcatttcgaacgtgacccctccgggaggaggaaccaccgattatgctgtcgatatttattattcggcagtaagaggagaaaaatttgtgtgccctatcaaagaaggcactttaatggatatgatgtatatgccggacgcgctgaacgcagcaatcatgctaatggaagcagatccgaccaagctgatacaccgcaacgctttcaatatcgcctctatgagtttcgaccctgagacgattttccatgccatcaagaagcatgtgcccgcgttcgagatgatctatgatgtagatcctttgaagcagcgcatagcggacagctggcccgatagtctggatgacacttgcgcccgcgaggagtggggatggaagccggcttacgatctggaaagcatgacggtggatatgcttgaaaagctaagagagaaactgaaaaaatgaaaaaactaattgcgggggttctggtgcttactatccttggttcctgtggaaacaagaaaacgaacatcgacccctttgcatctatcactcaagaggtggattctatccggcacaaagccgattcgatccatcaggaggaattgccggaagagcccaaaccgacagaagcggacgaatctttcgacgattttatctataattttgcttccgatgatgccttgcagcgtcagcgtgtcaagtttccgttgccctattacaagggagatgagaaaaccaatatcgaagaacgcaactggaagcatgatgacttatttaccaaacagcattattatacgctcctgtttgataaagaagaagacatggatttggtgggggacacctcactgacctccgttcaggtggaatggatattcgtgaaaacccgaatggtgaaaaagtattattttgagcgtatcaaaggggcatggatactggaggctatcaatctgcgccctgttgagcggaatgaaaatgaagactttgtggagtttttcagtcattttgctgccgacagcctttttcaaagccggcgtgtgcaggagcctctggcttttgtcacctcagatccggacgatgacttctctattctggagacctctcttgatttgaaccagtggtttgctttcaagccggcattgcctacagaccgcctttcgaatatcaattacggacagcggaatgatgataactcgccgacaaagattctcgccttgaagggaatcggaaacggcttctctaatattctatatttcaggcggaaagcaggcgaatggcaactgtataagtttgaagataccagtatttagcaacgaaaaaacggaagatatgtattctcttttatcacacaatacgttcggcattgatgtctatgccgaacggtttcaggaatatgcttcggtagaagaactgaagacattgatagctcaaggtgcccttacgacaccttttttgcatataggcggtggaagcaacctgctttttgtcaaagactatgaagggctggtcttacattcccgcatcgaagggatcgaggtgacggaagaggacgaacggagtgtagccgtacgggtaggagcaggcgtggtttgggatgactttgtaggctattgcgtagagcatggctggtatggaacggaaaatctctcccttattcccggtgaagtgggagcgagtgccgtgcagaatatcggtgcctatggcgtggaagtgaaagacctgatcacctctgtcgaaacagtgaacattcacggtgaggagcgtgtttatgctgtagatgaatgtggttatgcctatcgcgacagcattttcaaacgtccggagaataaatccgtatttgtgacctatgtctgtttccggctcagcaaggaagaacattatacattagattacggcaccatccgtcaggaactcgaaaagtatcccgaactgaccttgccgatactccggaaagtgattatcgatatccgtgaaagcaaattgcccgacccgaaagtgatgggaaatgccggcagtttctttatgaatcccatcgttccgcgcgaaaaactggaagccttgcagcaggaatttcctcgaatccccttctacgaactgaatgacggacgagtgaagattccggcaggatggatgattgatcagtgcggctggaaaggaaaagcattaggtccggcggcagtgcatgacaaacaggccttggtgctcgtcaatcggggcggagcgaaaggtagtgacatccttgcactttcggatgcggtgcgggcttctgttcgtgcgaaattcggcatagacattcatccggaagtaaatttggttggaaaatgaaagtaagaatacttggaagcggaacatcgacgggagttcctcagattggatgtacctgtccggtctgcacttctgccgatccgaaagataatcgtctgcgtgcgtctgcgatcgttgagacggaagatgcgcggatacttatagactgcgggcccgattttcgggcgcaggtgttacaccttccttttgagaagatagacggtgtgctcattacgcacgaacattatgaccacgtgggcgggctggatgatttgcgtccgttttgccgcttcggggcggttcctatctatgccgaagaatatgtggcacgcgcattgcgtttgcggatgccttattgttttgtcgatcaccgttatcccggtgttcctgatattcccttgcaggaaattgaggtcgggcacgccttttccatccaccatacggaagtggtgcctttgcgggtgatgcacggtcggctgccgattctgggctaccgtatcggcaggttggggtatatcacggatatgctgaccatgcccgaagaatcgtatgaacaattggaagggatagatgttctgattatgaatgcgcttcgtatcgctcctcatcctactcaccagaatctggaggaggcattgaaggtggcagaacgtattcgggcaaaggagacatacttcatccacatgagtcatgatatggggctgcacaagaaggtagagaaggagcttcctgaaaatattcaccttacatatgacggaatggaaatcattttctgattattggtgatttttttagcaaaagttttgttttctttgtagaaattattatttttgcccctagccgataaacagcaaatattatgaaacttcgtacgatagtgaaaatagcgatcacttcttctgttgtacttttgtgctcaggttttgcgttgtactctttttttaggttgtcggctgccgaagatcagaaagatttcgatctctataccttggttccatcctctgtttcagcagtgtttgcgacggaagatgtagccgaatttgtaatggaagtggatgagctgacctgtagtcgggatcaccagtatctttatgtttccaaactcttttcttatctgaaacaatatctttattctcttctcgaagatgctcctcacggtctgagcaggcaaatgaatcagatgctgatcagtttccatgagccggacaatgatcgtaatcaggtgctttactgccggttggggaatggagaccgtgcgctgatcgaccgttttgtgcagaaatacgtttcgtcgggctatcctccgaaaacattcgattataagggtgaagatatcattatctatccgatggcggacggtgattttctcgcctgctatctgacggaagactttctggtgctcagttgtcagaaaaagctgatagaggaggtgatagatatccgcaaaaccggcaagtcgctggctgccgactctgcttttaaagaagtgcgggcgccgaagaaaagtccgactgttgctaccgtctacactcgtctggcaggaatgatgggatggacggagtttgatatgaagctgaaggatgatttcatttatttctccggagtcagccattatgtagatacttgttttaactttataaatgtaatccgccagcaggaatctgtcaaaggatttccgggcgaaacactgccctccactgctttttatttcagtaaacagggcattacggactgggcatccctgctttcctatggcgatacgcaggaatatgcgacggcaggcagaacgagtgaagtgttgaatcgggatcgggaattgtcgcgttatctggcagagaatacggggcaggatttggtggcttgtcttttccagcgggaagactctctgatggggcctgcggctgttttaagtctctcggtgatggatgtggctgaggcggaaaggatgttgcgctctttggtaaatacggctccggcagaggaaggaacaggccggaattcacgtataactttttgttatactccctctaaagcataccctgtgtacaggttgcctcaaacaacgttgtttacgcaactaaccagttttgtagagccgtccttgcatgttttcgctacattttatggtgggcgtttgctgcttgctcccgatgaagatagtttgtcacgatatatccgccagctggataatggcgaagtgcttgacggcgctttggcttatcgggcggggacggacggattgtccgattcgtatcatttcatgttgatggcggactttgggcacgtgctcgaacagtccggacatcaggttcattatgtgccggaattctttctccgcaactccgaatttttccgtaatttcattctttttgcgcagtttacttgtgcggacggggtggtttatcccaacattgttttgaagtataaatccgaatagaattcgaagaaaaaaactggcgaaaatagaggggaaaaatagctcttaatttgcgaaactaaaagctctgaaacgccttctggcagggcgcgaaaaccgaatggaaaccagtagagtagagaagagtatataattctattctaaagaaatagaattaataagaaaaaagatagagaattttgccgccgctgattcactttttattccattccgtaagatacctttaagagaattcatgaaggggtgtcaaaagaactaaagtgggggtgactaaaaagtcgattctatctctattctcctccttcctgaaggaggagagtttagttactattgacttttggcataccttcatgggggcttttccgtctcgctgtccaatctccttcgtctcgctgctcaatctccttcagctcgctgctcaattcctttcgcctcgctgctcagtccttttcagctcgctgctgaatctgcgttggtcccgaggtgaattcacttcagcccggtgtctggttactgcaggggacagtcataaaaaaactcccgacagaaatagttccatcgggagttttttatgcagattgtttttaattcttagaacggcaggtcgtcttttgcgtcacccatagtgaaatccggagtagcagacggagccgggggaggaacgggggcacccggagccataggagcacctgcgcctacacgttcaactttccatgcacggatactgttgaaccagcggtcgttccattgacgggcgtcaacgtcgaatgatacggtcagttcttcgcccatctgaatgttgaactgttcgattttgtcggcgccaaatacgtcgaaacacattttgcgcggatattggtcatggttttcgattacgaactcttgtgatttccactcgttgccgctagtctttgagactccacctctcggagggaggatagcgatgatttttcctgtaaattccattgcgataattttaaattctgcggcgaagttacaattttttaggaatatccctcacacaatgcttgttttttctttcgttttcttgggcagcacgaatcttttttcgtaactttgtgcgatatataattcaaaacttaaatactcgaaaatatatgaaatttatcgtttcaagtactgctctttccagccatttacaggctatcagtcgtgtaattaactcaaagaatgcgctgcctattctcgattgttttctcttcgaattggaagacggaacattgtctgtgactgtttctgacagtgaaacgaccatggtgacaaccgttgaggtaaatgaaagcgatacaaacgggcgttttgccgtagtagcgaaaacattgcttgatgcactgaaagaaattccggaacaaccgttgacattctacgtcaacacggacaattatgaaatcaccgtgcagtatcagaacggaaaatatagtctgatgggacagaatgctgacgaatttccgcagtcggctgtgctgggcgaaaatgcagtccgcgtggagatggaagcaggtgtactgctgggtggcatcaaccgttcggtattcgcaactgccgacgacgaactccgtccggtaatgaacggtatatatttcgatattacaacagaagacatcacgatggtggcatcggacggtcataagctggtacgttgcaaaacgctggctgccaaaggaaacgaacgtgccgcgttcatccttccgaagaagcccgctacattgctgaaaaacctgcttccgaaagaacagggaacagtaaccatcgaatttgacgaacgcaacgctgtgtttatgctggaaagctaccgcatggtctgccgtctgatcgaaggacgctatccgaactacaactcggtaattccgcagaacaaccctcataaagtgactgtagaccgtcagcaactgatcggagctttgcgccgcgtgtctatcttttcttcacaggcaagcagtttgatcaagctgcgtatgcaggagaatcagattgtgatttccgcacaggacatcgatttctccacttctgccgaagaaacacaagtttgccaatattcgggtgccgctatgagcatcggattcaaatctactttcctcatcgatatcctgaacaatatttcggccgatgaagtggtaatcgaacttgccgatccgtcgcgtgccggagtcattgtgccggtagaacaggaagaaaatgaagacttgctgatgctgctgatgccgatgatgctgaacgattaattaattatttaatggataattgagaatggataatggataatgagctgcgctgtcagtggtcaggaattatccattttttatgtttcctatccattatcaattctccattatccattatccattaaagaaagaaatgaaattaaatttgaaaaacccgattgtgttcttcgatctggagacaacgggaaccaatatcaacacagaccggatcgttgaaatttgctatctgaaagtatatcctaacgggaatgaggaaacgaaaacaatgcgtatcaatcccgaaatgcatattcctgaagcctcttctgccgtacatggcatttatgacgccgatgtagcggactgcccgactttcaaggaggtggcaaagaatgtggcccgtgacattgaaggctgcgatttggcaggattcaactctaaccgcttcgatattccggtattggcagaggaatttcttcgtgccggtgtagatatcgatatgacgaagcgtaagtttgtcgatgtacaggtgattttccacaaaatggagcaacgtaccctttcggctgcctataagttctattgcgaaaagagtctggaagacgcccatacggccgaggccgatacacgtgccacttatgaggtgctgaaagcacagctcgaccgctatccggatcttcagaacgacatcgccttcttggcagaatattcaagtttcactaagaatgtggactttgccggacggatggtgtatgacgacaatggtgtggaagtatttaatttcggaaaatataaaggaatgtctgtagccgaggtgctgaagaaagaccccggatactacagctggattttaaacagtgatttcacgttgaataccaaggcggtgctgactaagatccgtctgcgtgaaatgagtaatttgattacaaaataatgctaaaaggaaaaaagataattcttggaataaccggtagcatcgctgcttataaagcttgttacattatccgtgggctgataaagcagggagcggaagtgcaggtggtcattactccggcgggaaaagaatttattactcccatcactctttcggctttgaccagtaagccggtcatcagcgagttctttgcccaacgggatggtacgtggaacagccatgtggacttgggtctgtgggcggatgccatgctgatcgcacccgctaccgcctccaccatcggaaagatggcgaacgggatagccgacaatatgctgataaccacttatctttcggccaaagctccggtattcattgcaccggctatggacctcgatatgtatgcacatccttctacccagaagaatctggatatattgcgttcttacggcaaccgcatcattgaacccgcaacgggtgaacttgccagccatctggtcggtaaagggcgtatggaagaaccggaaaatattatccgtgtgctggacgagtttttctctgcgagtgccgaacttcaaggaaggaaaattatgataaccgccggaccgacttacgaaaagatcgatccggtccgttttatcggcaattactcttccggtaagatgggatttgctttggcggaagaatgtgcccgtcgtggggcagaggtgacgttgatcgccggaccagtgcaactgaaaacgcagcattcgcgtatccaccggatagacgtggaatctgctcaggaaatgtatgaggcagcgcaaacctgtttcccgacttccgacgtggggattctttgtgcggcagtcgccgatttccgcccggaaacggtggccggcaaaaagatcaaacgggagaaggaagaagaactgaccttgcatcttcaggctacgcaggacattgctgcaagtctgggaaagatcaaagaagacaatcaactgttagtgggctttgccctcgaaacaaataacgaacagcagaatgccgaaggaaagctcgaacgtaaaaactttgactttatcgtcctcaattctctgaatgacgcgggagccggcttccgtcacgatacaaacaagattagcattattgatcgcaaaggtcgcgaggattatcctttgaagcccaaacaggaagtagcgcaagatatcatcgaccatctggttgctgtcttgactcactgatctttattttttaggtttaatttttaatttacagaaggtgttacgttcactttatattcagaattacgcattgatagaaaaactggatatcggttttgaaacaggcttctcagtcatcacgggtgagacaggggccggaaaatcgattattctgggagccatcggtctgctgctcggacagcgtgccgatgtgaaagcgattcgtcgtggagcttctaaatgtattatcgaagcacgttttgatatctcggcttacggtatgcgcccgttttttgaagagaacgaactggaatacgatgacgaggaatgtatcctgcggcgcgaagtgcaggcgtccggcaaaagtcgcgcattcattaatgatacgcctgcttcactggcacaggtgaaggaattgggcgaacaactgatcgatgtacattcgcagcatcagaatcttttgctcaataaagaaggtttccagctgaatgtactcgatattctggctcataacgatgatgcgctggagaagtaccattcactgtataatgaatggaagctgctcgaccgtgaattgtccgagctgacggcacttgccgagcaaagccggacggatgaggactatcttcgtttccagttggaacaactggaggaggctcatctcgtggaaggggagcagagcgaactggagcaggaggcggaaactctgagtcatgctgaagagatcaaagcgggactttaccgcatcgaacagtcttttttctcggacgaaggcggactgctttctttcctgaaagataatctgaatacgctgaataatctgaaaaaggtgtatcagcctgccggagaactgagcgaccgcatggaaagtgcctacatcgaactgaaagatatttcgcaggaagtctcagcgcagggagaatccatcgagtttaatcctacccgtctggacgaagtgaacgatcgtctgaatctgatttactccctgcaacagaagcatcgggtacagacacttgaagaattgatggccttggcagaccaatatcgcagtaagctgtccgagatcacctcttatgatgatcgcatagccgaactgactgcccgcaaggaagcccagtatgaacgggtgaagaagcaagctgccgtgctgacaaaagcccgtgcggcagccgcccgtgaagtggagaaacaactggctgaacggctggtcccgctgggtatgcccaacgtccgcttccaagtggaaatgggattgaagaaagaaccgggcatacagggggaggatactgtcaacttcctgttctccgccaacaagaacggaacgttgcaaagcatatcttccgttgcttccggaggtgaaatcgcgcgtgtgatgctttctatcaaagcgatgatcgccggtgcggtgaaattgcctacaattgtatttgatgagatcgataccggagtttccggtgaaatagccgaccgtatggcggatatgatgcaggaaatgggggactgtaaccgtcaggtgatcagtatcacacatctgcctcagatcgcagctcgcgggcgcgctcattataaggtatataagaaggacagcgatacggaaacgaacagccatatccgccgtctcaccgatgaagaacgggtagaggagatcgctcacatgctgagcggagccacattgaccgaggctgctctcagcaatgcgaaggccctgttggcccgtacttcataatacataattcaaaatttataattcaaaattacaatgaccgataaaagtgaaatgattttcggcgtccgtgccgtcatagaggccattcaggctggaaaagagattgataagatcctcgttaagaaagacattcaaagtgatctttccaaagagcttttcgcagcattgaaaggattgctgattcctgttcagcgtgtgccggtggaacgtatcaaccgcatcacacggaagaatcatcagggtgtggtcgccttcatttcctctgtgacctatcagaagacggaagacctcgttcctttcttattcgagcaaggcaagaatccgttttttgtgatgctggatggcataacggatgtgcgtaacttcggtgcgatagcccgtacctgtgaatgtgctgcggtggatgcggtgattattcctgcgcgtggcagcgtatcggtgaatgccgatgccatgaagacttccgcaggtgcgttgcatacattgcctgtctgccgcgaacagaatctgcgtgcgactttgcagtatcttaaggacagcggtttccgtatcgttgctgctaccgagaaaggagattatgactatacgaaagccgattatacgggaccgatgtgtatcatcatgggagcggaggacaccggtgtatcatatgatcatctggctctctgtgacgaatgggtgaagataccgatgctgggaaccatcgaatctctgaatgtttccgtagctgccggtattttgatttatgaagctgtgaaacaaagaaacaacgactgatatgaagaaacttttaatcttacctttagcgcttttcctcttggtacagagcggtctggcgcaaaccccgaaatgggtggagaaggcgaaacgtgctgttttctcagtaataacttatgataagaatgacaagatgctgaataccggaaacggatttttcgtatccgaagacggactggctctctctgactacagtctcttcaaaggggctgagcgtgcggtgattgtcacagccgaaggcaagcaaatgccggtcagcctgattttgggagcagatgatatgtacgatgtgatcaagtttcgtgtggccatcaccgagaagaaagtgccgtcactggtagtggcgactactgctccggttacaggcgctgacgcatggatgcttccttattctacgcagaagagcattgcctgcgtttcgggtaaagtgaaggatgtatcgaagattgctggagaataccattactataccttgagtatgcagatgaaagacaagatggtgagttgtccggtgatgaatgcggaaggccaggtgttcggtatttcacagaagtcctccggtgcggatacggtaacgacttgttatgcggcaggggcagcttttgcaatgtcgcagaagattagtgctctgtctttgggagacgttgctctgaagaatatcggtatccggaaaggattgcccgaagcggaggatcaggcattggtgtatctgtttatggcttccacgcagatgtcggctgatgaatatgagaaattgctggacgatttcattcgccagttccccagcagtaccgatggatatatccgccgtgccaactattacgtagcaaaaggtaaggatgaccagtcttattttgacaaggctgtagccgactttaatcaagccttgaaggtggcggctaaaaaggatgatgtgtattataatatcgccaagctgatatacggttatcagctttcaaaaccggaaacgacttataaagactggacgtatgatacggctttgaaaaatctccgtcaggcgatggctatcgatcctttgcccgtttatacgcagttggaaggagatatactttttgcacagcaggactatgcaggtgctttggccgcttatgagaaggtgaatgccagcaatctggcttcagcagcctcattctttagtgccgccaagacgaaagaattgctgaaggcagatgccaaagaagtgttggcattgatggacagctgcattgctcgttgtccgcagcctgtcacggcaaattttgctccttatctgctggaacgtgcacagatatatatgaacaacgatcaggcaagaaatgcaatgctcgattatgatgcttattataaggctgtgaacggacaggtcaatgaccttttctattattatcgtgagcaggctgcgctgaaagcccgtcaatatcagcgtgcattggatgatatcgtgaaagcggttgaattgagccccaaagatctgacttatcgggcagaacatgcagtggttaatctgcgtgtaggacgttacgaagaatccatgaagatactgaatgaaattctgaaagacgagccgaaatatggggaagcataccggttgttgggcctttgtcagatacagttgaagaagacggacgaagcttgcggaaacttcaataaagcgaaggaactgggtgatccgaatgtggatgaacttataaaaaaatattgtaaataagcggaggtgcttggaaagaataacgtcttactttcttttcggactccttagtagtaaaaataaacccctgccggcttctacagtcggcaggggttctcgtttttggggacgtttgtaaaatactctctctctctaatttctccccacttgtcaagttcaggtttcaggtcttaatatgatatataggtttgattctttttttctcccgtttataagttaaatgcagcagtttatagaatactgcatcctttctttattttttttctcagaatagttatttttttctttttatggtaaaatcttctgattgaggtggagcttttaattcttttttaagggctgggcaatgaaaatattgaatatttcattgttcgtaaatggtataataaataggtgttgaaaatgaaacaaacagatatttccctctaattatggtcgtttaacgaaaatattattgttttttatttgcgtatattggtaaatatggtcatctttgcaccgttattcgtttctgtttgttaaagaataacgaataagtgtggggtaaatagatgatttttagtaaaaaagacattcaagaagttctgccggcagatgtgactggcaggagcgtagcgcaccctaaacgttggttggtggctttagtacgtatttctcatgagaagaaaacgagtgagcgactatctaaaatgggtattgaaaacttccttcctgttcagcaagaagtgcatcaatggagtgatcgtcgaaaggtagtcgagcgtgttcttcttccgatgatgatatttgtgcatgtcgatatgtatgaacagaaagaagttttgacattgggctctatcagccgatatatggtattgcgtggagaaagtactcctgctgtcattccggatgaacagatgcaccgctttaaatttatgctagactattcggacgaggcgattaatatgagtacgactcccttgtcaccaggaaccaagattaaggttatcaaagggccattatccggacttcaaggagaattggttacagtaaatggaaaatcgaaagtagcagtccggcttactatgttgggatgtgcttttgtagatataccagtagggtgtgtagagcctctggagaaataagggtttaaatataagtgaaacaagcattaagtgaataaaaggggtatggtgagttttttactacaagaaaatattgatgaactgcaacatctggcagatcatttacttcacatcggtgataaaaatgggtatgtatacgccgatgacctttctgcattacaacaatcaattcacgaaaagataaacgatttatattcacaacgggggaagacaccggaacaggatgctaccctgtgtttggccatccttcagggatataatgtgtcgatgtacgccaatccggaagacgaggatagaaaacggtctgtcttgcagcgttctctgaccctccttgatgctcttcccccttctcttcttaaacaacagttgtctgccgtctgtcatggtatgcaggaactgtgtgaaaccaactaacttttttatttgtcaatgaaaatacaacgactttttagcattctacttttttgttctatgctgggaagtggctcgcttatggcccagtccatgagtgactcacaggtactggaatatgtaaaggacggcatccggcaaggcaaggaacagaaacagcttgcttccgagcttgcgcgtaaaggtgtgaccaaggaacaggctatgcgtgtgaagcagctgtatgagcagcagaacaatgtaaacacctcccaatccacgggtacggatatcaacgagtcccgccttcgtgaagaaacaaaggagaatacttccgacatgctggaagatcatccgactacggaagatttggcccgtgaggaccaggttttcgggcgcaacatcttcaatacccgcaacctgacgttcgagccgagtgtcaaccttgccactcctgccaattaccgcctgggtcccggtgatgaagtcatcatcgatatctggggtgccagccagaacacgatccgccagcagatctctcctgaaggcaccatcaatattcagaagatcgggcctgtcaaccttagcggtatgacagtctccgccgccaacgactatctgaagaacgccctgaataaaatatataacggtctgaataatactaccggcaaagatcgagacttaaagatacaaagacaacgggtactttatcgggggcttactaaacaaataatatgaactttaatgccgttcatatgtttcataccttctgttaacatttgaatatagcgtacaacaccggatggattgccagtttctattctgaggattacaacatttttttctatcatttcagcattatatagtgtccggtggattttatatcttggaaattaagacattccataagtaacaattggggaattcctccttttagtctacttaatgtcagccgattttctttatataaataagattctttattaaacaagaggcttgacaattgtttctttaaagatgtccattcactttctttattaagaagttgtaatttattcagattgtaaataacatcaattgattcttttaagtttagggtttccaaaaccatatttgaaaagtagcattttataatcgcatttgccagctttatgatatctttgcgtttatggcacaaaccatattgcaaaagattgactccaaatgatatattagtacaaacatgtttatcactgattaattttttatgtgtttgtactattatgtcaattaatgtttctcctcgaatacttaattcttcataaagattatagagacagagcattttcgtagcatggtaatagaacaaattacgttcaaacaaacttttaggaatttgttttaggtaatcatagaggttctctattaaattgggaagtatttcatcaaaatcagattcctgaatatatgatttagaagctattaaaaacgatatagcgtcgtttttagatacaatattgttcatatctgtttttaattgttttatgaatgctactatttctttatgttcttgaccatataattccagataatcagcttcaatatattctttttcaataagatgaataagagaccatgctattcccatttttccttcattaaatgtattgcttttcataggagaagctagtacctcttgcaataactcaaaagcatgtttttcagctaaagcatccttaaaatagtgagaatattcgaaaagaattaaagaataccccattttaccaaacatcagactagagttgtctaatgaatatccatgtaataatataaagttcaccaaaaaattatttttcatacttcgtttatattaactcgctttaatagggaaatcttcaatattgaattgtactatggcagaatggttgtagtccttctttgtggcaatttcaataagcagtgttcgaaatcagtgacttagtattgtttcttgacttaatatcaatattcaaggtagtcttcaatcttaaacttttcatcttttacaataaattttaaatatcgaccatataacattttcttgtcaatggttatcagggggccaaaactgttttcaggaaacttccttatttgtttttctaaataagatacaatcattttctcgtcggtagataatgttttcggcaataagaggtgtggaataatttgtcctgttttagggactacttccaatagaaatgaatattccctcccaacatgtttgctaaattctgtagaaaaattttcattaattaggggagagattaaaaaatctatattccttttaatgtcatcataccaacatccgtcttcgcgtattaatatcatgcctcctttttgtggaaaacaagaagattcaaacttaccctcatctggagttatttgtttttcgtcagatatcctacctttatgaatggatatgagtgaagctttctttgatacaactgtattaaatagctttcttgggcaatgcaaaacgaataatctaccagtgaaccatttggcaattataccattataacctgcgggcacatcttgatacatagctgattctctcattccatatttctcttttattttttgtaattcaagagaagcttgttttaaggaatctttgttttgcggaaatatatcttctaaaaatagatacttacagtttctgtttgggattctccattgagctacacaacaaaattctttctttaaaggtgaaggatacataaaggaaggctcatagaagtaaccgggaacatatatttcgtcataatcttgaggaacactatttttactatctttgaaaagactaaacatgtcagttagagacagaatctcatatttgtcgtctgcattattttgagcatagattaaactaggcaataaatatatgaaaagtgatataattctatttttcataattgttgttctcaatatggaatataggtatcagttggctcatgataaatataaaattctttatatccaatttcttgtaatttactctttgtttcatagtctgcatcacttggatagttagcatattcactctgatggttatgatattttatatcacatccactatacgccattgacacttctttttcttgatgattggtacctgcgaaaaaatgataagttgaactatccacgcacatagaccattctacagaagtattttgagttaaaaaactatagatatctcgattctgttcactagtaccttcaataaccaattgaccagaagatatttgaaaagatgtacctttaggcaattccattgttggagccccatcccatgatcccattgatacaagaacctcatctgtatttgtttcgttagagtaaagtacacgcccatccactccaattacatataaagtacctccgattactcctttttcttcattttgactcaatacaggcatttcttttcgaatttcatcaataagtgcccttgttaatttttgtttcataagtgtttgattttagttttgtgatttcacaaatatagaaacgatgggataaatccccatcttatttgcatcttaattatcagcggacttttctttagcttttaaatgaggtatttcgtattcttctatgattggtggatctattacttcaatataatctttaggctctctataccaaaataccttttttaatgatcttatatattgacttaattttctagcacctttgtcattataaaagcaatacagaacaatacatccgcgacgttttttttgaataatcattacttggcaatgattatacttattttctaaattttcccacattcttaaaggatatgtaattacagtatccgcattatatgctttacgagcatattttaaagatttataagtgagaggaaggtcgcataaagaggtcactctttcccctgtatttacaaaaaaatctcctttgattatttctaaatgataagtattcacttcaatcataaatcctgttttaaaactaaagtcagcataaatggaatctttatccccgcaaaatatgggaggcacagatacgtatgcaataaaattactgtcttttgatagtatacaattataatgtcgattaaatgcatgtgctctaacttgttttgaagtaatgcatgttaatcgatcaccgccgggaatataatggaatacaaaatcgctggactgattaaatcgtacttggtttctatccaatgcatatccatcagatatatatccaccagaattgaataattctttagtttttttatcttcttgagaatatacttttgatatactcaaaagtaataatgataacaagactaaatcttgcagaactcgcatagctttttattaattgtagtattaattatagtaactgtaatcactgttagcagtaccattgtagtcactaatattttcataattataattcccgtaataactattaccatagccataactatcttcgtaattaccataaccaaaataaccataggcatagccgtagctttcctcatgagcaccaatggtagtatcaatgtcggctttttttattcgatatattgtggatatatccgaaatgtctacttttcttacctttttcccatcttccccctctagggttgggtcaaaataagagatttttccgttttcatctggtactgcaaagactataatagtatgtcctgtgccatcaggatttaccatagttgcaacttgataatagtctctgttagaagtcattgaacctggaactgtattaccaaatcccataacgctaaggacatttccaattaattcattgggaactcctcccattgctgtaggatcaagaccataaatatctttataatcattagcataatcttgcgcagatcgggagggatccatatggtgcatgcaattgaataaacaatcccaacttgtagttccaccatctccaccgttgcaacatctcatttccatttctgtcagtactggcatctctttccgaatctcatcaatgagtgctcttgttaatttttgcttcataagtattaaattttatttgtgtgattctgcaaatatagaaataaatttcgcatttttgcaagaaatataaatctttttttatgcaaacaagacaattcccctgggagtaccaaatggatgcaaaagactgtggcccagcatgtatcaaaatgatagcaaaatactacggcaaatactattcgttgcaatatttgagggatttatgtgggataaccagagaaggagtttcctttttggatattagctatgctgccgaaaaaatagggctaagaactgtagcggttaaggcgactatggagaatctgaccaacaggattccactgccatgtatcatacactgggaccagcaccacttcatagttgtgtataaaacaaaaaaagggaagatatatgtgtccgatcctgccaaaggcttgctttcctatccggaagaggatttcaaagacagatggtataaggaaggggaagaattcgggatgctgatggtactggagcctatggcaaacttcaagcaaatagaagctcatgaacggatcgaaagattcaaaagtttcgaaaaccttctcaactattttacgccatataaaaaagcattcggcatattgttcgctatcatgttgatagccaccggactgcaagcagtacttccgtttatctcaaaatctgtaatagatataggtatatatactcaggatatatctttcatctacatgatgctaatcggcaatattgttcttttacttagtataacgctgtcaaatgtattaagagactgggtcttgctgcacgtttctacccgtgtcaatatctccctcatatcggactatctgatcaaattaatgaaattaccggtgactttcttcgaaaacaaactggtcggtgatatccttcaacgggcgggcgatcatgaaagaatacgcagctttgtgatgaacaactccttggggatgttcttctctatcattacattcgttgtattcagcattatactgttgatttataatcctatgatcttttttatttttatagcgggcagtgggatttatgtagcatggattttcacctttttgagcatacgtaaaaagctcgactgggagtatttcgaactgaatgccaagaaccaaagttactgggtggaaaccatcgaaaatgttcaggagattaaaataaacaattacgaagaccttaaacgctggaaatgggaagctatacaggcaaggatataccggttgaatctgaaagtgctgaaaatcaataatgcacagtcgcttggggcgcaatttatcaatagtatgatgaatattgccgtcacgttctactgtgccatcgccgttatcaatggagatatcactttcggagtcatgatctcaacgcaatttattatagggatgctgaacggacctgtggcacagttagtcagttttatacaatctgcccagtatgctaaaatcagctttatgcgtatcaatgaaattcatcagctgaaagatgaagacgattcttcgcctgtgataagcaacagtctgagtttgcctgtagacaaaagtttatatctgaagaacgtatcatttcagtattcgagaaatgctccgctggttttgaaaaacatcaccttacagattcccaaaggaaaagtgaccgctattgtcggagacagcggatgcggcaaatctactttactcaaactgttgttgcgtctatacatgccttcttacggagaaatctgtatgggagatatgaacgtgaataatatcagtctgcgcaattggcgtgctaaatgcggctgcgtgatgcaggacgggaaattgtttaatgacaccatacagaacaacattgtactggatgatgccaatattgattatgaggcattgcagaaggctgttgaagtagccaatatcagccacgagatagaagctatgccgcagggataccagacaatgatcggagaaatgggcagaggtttgagtggagggcaacggcaacgggtattgatagcaagagcgctctacaaagatccggactatctgtttctggacgaagctaccaatgcacttgatacgattaatgagcaaaagatagtaagggcattaaataacgttttcaaaaacaggacagtcattgtggtagctcatcggctaagtacgattcgcagggcagaccaaatcatcgtattaaaagcgggaatgatcatagagacaggcaatcatcaaagcctgatgacaaacaaacagtattattacaacttaattcaaagccaatatgaaccggaaacaaacaccttctccacagaagaaagcgcagactaaatcatccggaagaagtgaagagctgggtgagattattgaccggatgcccatggctttcgggaaatgggtggcactggcagtcgttatatttgcagcattattcctattgttcggatggattatcaagtatccggacatggtgaccgggcaaattaaaattaatgcgcagaaccctaccataagacttgttgccaacagtacggggaatttgctgcttctttcgcacaaagcacaggaggaggtgaagaagggggaatatatagcggtcgtgcaaaatcctgcttctacagaggatgtgcggaagattgcggatttaataaatcgaatagatttcgatggcacccatttgcttgctcttaaagatacatttcccgacaaggtatatttaggagaaatcaaccctcaatactatgcctttcttgcagctctgaaagctcaatgtgactatctgcagcagaatgtctacgaaaagcaaagagagaatatcacgacgagcattgaatggaaaaagaagattgtccgagaagcggaggactcgcagaaagctgcaaaagatagaatggatgttgcccggaaatggcttaaacgttatgtctctcttgatcagcaggaaatagcgacttatgaatatgagaccgatcagattaaaaataattacctgacaacagtacaggaggtacaaaacataaatagggagattgcctcgacccgcatgcaaatcacagaagcataccatcggctggagcaactggaagtggaacaactggagaaagaacgggaactgaaagtggaacttttgtccactcatcagaacttgatagcaaatatggccgcatgggaacagaaatatgttttcaaagctccttttgatggaaaagtagagttcctgaaatttatttcagatggtcaatttgtgcaggcaggagaagcggtatttggagtgatacccaaggaaaaccatatatatggtcaggtgttgcttccggccaatggagccggaaatgtaaaagaaaacagtaaagtcgttattaagttagagaactatccctacatggagtatggatatatagaaggatatgtatcttctatctctttggtcacccaaacgcagaaaacaggagaaaagaccattgaaacatatttgattaacgttgaattgcccaacggattaacaactaattatgaagagactctcgactttaaatatgagttgggaggaaccgccgatattattgtaaaagacagacggttgatagaacgcctgtttgataatttaagatatcggactaaataaagctcatactcaaatttacgctccataggaattcaacacgacttttgccctcacgctctaacagtctgtctgtatccctttattcatcgtggtttcgggtgtggtagcaagtgtggtggcaagtatgagagcaaacggttgctctcactcagttccgtcgcattatatgttgttttttgctgctattatttgatttacagagtattaatatctgaagtgtcaactattaacgattgatatttcagccattaataactgagaaatcaggtgttaatagctgataactcacgcattattgaccgatatatgattgaatgcttcctgaaagatcaggttgattgaaacatttcatgcggtcaaatcaatccaatcatataagtcaagcgccagtttcctgcttgggaaactggcgttcccttataagggaacgccagttccaaggcaggaaacgagcgtttccgatatagggaacgctcgtttccaaaataagaaattaaaggaaactgtaagccattcagatacaatgatatagggaaatcatggtaagaaatgaaccatctacgtgtgattgatgtcgtattttattataaggttaatgcgagcaaaaagtctgtttttattagaggaaaagtttgtatgccgtaatataatatcgtacctttacaggaattaagcgataaacaatattggtagataaacagacaaaaaagaatgaaaataactttaatcagacaagacagcgggagtggaaaagaagctctaagcatatgcgaagcaggtacattattcaacaaaatgaaaacggagacaaaatcgggacacattacggctttgcgaaacctgataccgatgctggaaggtacgtacagccagtacgaacatatagacaaactgccatatatctattctgccgtagaatgtacccgcactaaagaaggcgaacgaaaaatgaaacaatataacggactggtgcagttggaagtgaaccggctggcaggcccgtccgaaatggaatatgtgaaacggcaggcggcactcttgcctcagactttcgccgcattctgtggttccagtggccgtagcgtgaagatatgggtgcgttttgccctgccggatgacagaggactgcccgaaaaagaagcggaagcggaattatttcatgctcatgcctactggctggcggtaaagtgctaccagccgatgcttccttatgatattaatctgcaagcaccggtgctgacacagaagtgtcgcatgacactggacgaatctccatattacaatcccgatgcagtgccgttctgtctggaacaaccgctcgctatgcccggtgaagaaactttccggcagcgcaagcagggtgaaaagaatctgttgttgcgattgaaaccgggatatgagtctgcaaaaactttcacgaagatttatgaagcggcgttgaacagggcatttcaggaaatggaagactggaagcgtggagatgatttgcaacctttgcttgtacaccttgccgagcattgtttcaaagcgggtatccccgaagaagaagcggtccggcagacactcattcattactatcgggaagaggatgagcgaatcatacgctcgacgattcataatctttatcaggaatgtaagggttttggtaagaaaaacagtatcggaagggagcaggagacggcttttctgctggaagaatttatgaaccgtcgttatgaatttcgttttaacaccgtgttggatgatctggaataccgccagcgtgattccatccacttttactttaagcccgtggacaaacgtgtgcgcaacagtatctctatctgtgccttgaaagaagggatcaatgcctgggatcgtgatgtagaccgttttctgaattcggaatatgttcctttgtacaatcctgtagaagaatatctttatgatgtcggccgttgggacgggaaagaccgtatccgtgcattggcaggattggttccatgcacgaatccgtactggcaggagttgttttatcgttggtttctgagcatggtggcacattggagaggggtagatcggcagcatggaaacagtacgtcacctttgcttgttggtccgcaagggtatcgtaagtcaacattttgccggattatcctgccgcctgaattgcgtttcggctatacggacagtatcgatttcaagagtaagcaggaagcggagcgttatttaggacgtttttttctgatcaacattgatgagttcgatcagatcaatgtcagccagcaggggtttctgaagcatttgttgcaaaagcctgttgctaacttgcgcaagcctcatggcaatactattcgtgaaatgcgtcgttatgcttcctttatcggcaccagcaatcagaaagatttgcttgccgatccaagtggcagccgtcgttttatctgtattgaggtgatagctcctatcaaaaccaatgctaccatcaattacaaacagctttatgctcaggcgatggaagccatttataagggtgagcgttactggctggatgatgaggatgaaaagattttgaagcagacgaaccgtgaatttgagcaggcgagcccgttggaacagttgttccattgttatctccgtccggcggaagaagaggagggaggcgaatggatgacgtccatgcagattctgaattatttgcagacgaagacacgggacaggttggctatcaataaggtagctgtgttcggccgtgcgcttcagaagctgaatattccctgccggaagtccggtaaggggacactttatcatttgctgaaaatagaatgattggtagcaacgtgagggcaaacggttgctctcacgttgctaccattggatctctaatcgctgtaacttcgatgaataggggagattgaggcggaaatgagagcgtgagggcaaaagtgctgtcatttttcatttggaaaaaagttatttcgctacagtcgcctcaacgagactatccatatcaaaatcaatattataatccttttctatttgaatccttcttatttgattgaccagcgaatgcggtttcacccttcgggtcatctctatttccagcaacctttcgggaaagcgtttacggatttcatctatatttctcatgaaaagtgaatctttattttcgtagagagaattggcggcttctgccaggataaaagctcccaagctgtcgggatattgttttagtactgcttgaaggaaaaccttgctttttccaaagctttcgtgggcttcagcgtgcatatctttggcagcttgaagtagtcccagttggaacagatactcaccggtaattgcgtttttctccatagcaagtgtttgtatgtatagggcggagtccagttctcccatttcagataaaagtttggctttcatgccgtaatagtcgggatttaaactgtcgattgccaaagctttgtccagaaagcggatgcattttcgggtggagtctacatcataggaagattccatcagggctattgcttgttggtagaggctgtctgcctgaagattgatacaatgaggagtgatgtctgctttagactcttgccgggaatggcaacctgtagctgcaataatcattggcaagatagttaataagaggcttaatttcttgggtttcatattcataattcttatcatccaattttataaaaagtaagactggcgaagaactcgataagaaaatgtgtctaatctgatcttattttgttcttcgtcagtcttttcttgttttgttaaatgcctagctgctctcttgcccaggcttcatcgtgtcttattctgtaaaggtatatttcggacatattccaccatgcgctgcctgcgacagtataatccaatggatctttgtcacggcgagccgtaggagtaaatcggatatagttgtaagcttgctttccactcacattgtttttagctgtggcatggccaccgtttgttgtcggcagattgaattcttcattacccatactttcaaagaactcaccgttcatacttccatatattgttgcggcttttacgtcacctccgttattcactctgctttgacgtgcatcatattcaaaacaaaggtcctttaatggtttgttcagtttgatctggacataatgtgcttctgttgtaacaggagcattccacttggtatgataataagtattcaccttcccgtcaatcaatgccggtaaaccgcctccgtctccgacatgattagcattgtcggaaagcatatcgatagtaagagtaacacgttccatttcggaagcttcgccggaaatgcctgttattgttaccggactatctgtctccataccagtcggaccataggtgttgatagtaaatgagtattcacctgcacattggtaagtatcatctatgatataggatgttgtcttatagtcatttattaagatctctttattttctttcgtgactttatcgtaataggtaatctttatcttgttgaagtctacatcttcaggtatctcccattgcagctgaatacttccggctcccggagtagcagtagcattgatcacatttaaaggaggtgtcgcgataaatccggcctgttttactgtgactacgaactgacttggtactttgtcggtgctattggtactcttgaaggttatctttccttcacgaggttgattctcaacttcagtgttggctttaatgataaagctttcggagacatcacgcagtgctcttgaagcgggtaatgatactggagtgatccaggattgggcggattcttcgacttcataggtatatgacacttcaccggcaggagaatttactttgaaaggaatagtgattgtttctcccattgctttcacttcatagatcttcttgtcttcatcgatttcgactatataacctctgggttgttgctttatcaggaaagaagctgtatagctgtaattctgggaagactggaggataatcgtacaataacgtacgtcagtctcggtgcttttatccagcgtaaatttcagttcctgtttgtttacgtcttccgctgcacgcgtctttgcatcaaatgtggcaggttgctctgccagacgtatccagttgcaagtgtctggtataatgatattatccagattcaggttggtcgctacaggaattgtcaatgtttctctttctgcatctattatttctacatatccttcctgttgtagcttgtcacctataaggatggccggttctttaccaaactgcgagacagtgatggaatagctttgatgaccataggctacagtgatttctgcccggcgttgtttgtatatattgtttgcactggcagatacgactactttgccctcgtgttgtactaccttgcaccattctgcattggactgggcactccatctgtcgagtggtacattggtctgcacttcaatttcatgttctcctcccagaagtgggaaagtgataggtgcctgacttttatcaggaactacgagcgtttctactttaaactcggtttcgtaatcgggcgaacaagagataagtccggaagcaattccgaatatgcttgcgagcccgatgattaatatattttttttcatactcatttgatttgattacaagttatctactcttgggttaaattcatatcgtagtttggctttcacttcccggtaaggggcggtggattccaggcgatatttataatgcagacggaactctttgtaataagtggcacgtccgtcgggagtacggatagcgtttaacaggaatgtgttgtcgtaatcatcgattggagtaagttgtactacatcgaccggatccacttccacatcattaactctgtcatgcgctctgatggtaagttctctggcctgaggattctccggttgctgctcgccaatttccagaatgatactcttagatacaattctgcttcttgctgtcttataatcgccaagatcttcatcacctgccatcatgcgtaccgaattggcaccgatcgggaatacttgattggcatttgtcggtctacggacttcgggactaccactggggttaggaattacaatcgtactgcttgtataattgtagtaggtagaagtctttgtcgttgcgtaatagttttctttatagatacgcaataatacatgacttttatccggattataattaggtgttttttccggatctatcttgtaatccagaaaataaatagaatccggtgaaatcctttccagatttttcagatagatcggaaacattactttggaagtgcctgcctgaatatccagttccttattgggaaaatcatagcattcatcgggaagcagtttggcaaatttttctttttctatatcaaagttggatttgttgtatgctttcagcaaagaatccgattccagaagagctacatggtgtgtgttagggcttatttgtgagccgctaaccgtggcaaccagatagatcgtatctttttcttgtcctacattagccacctgccggtcgtagatcagactcgaattactgagtaagcctacttcgttccggtattgttcctggtcgaaatcgtattcattgcaagcactcaatacacctataagggtgcagagcattatattaaatttctttttcatattcagtctgttattcatgttttgatattatctgtcccatccgaaattctggtcggcattgggaaccttcagcaattcatcatggcggatcggtaagaataccattttaggcagtgcaatgcggtctcgcacattttgtgtattgatcgtcacaatattccagaatccttcattaccgttggcatttgtacggtcttttgtcacatccagtccccgccagttggagctgttggcatcttcgtccagataggttccccacctgcgcgtatcgaaatatcggtatccttcgttaaagagctctacctgacgttcattgcggatgattttttcaaaattgtctgcttctgccatgtcgttggcatctactcccggcaagccgacgcgataacgtatcatgttgaaatatttagtcatttctgccggatcacggctaacggtttcctcaataagtgtacctgtattgtcggatacttctacggtcactgtaccttctacacggttcaatgcttctacatattccagtagcacttcaccataacgaatgatagggaacggtttagggctggtgacgaatgcgccttttacactccctttgccgttagcccatgagtcgtccggatgaatgtatttgacgggaacataaccgctgacactgtagtcgtttacgttatttccggcaccggcaattccggcattggtatcatcgtgagaataccagaattgctgattgacgtaggaggcgtcggtagaagctgaactcatcggccagtagcgacccggaaaacctatcgaggcatagaagcgtgccgaacgattggcgtacatcataggtacgttttccctcagtaggtatgtccccagttttttggattcgccggtgagtctgctgaagtccggttcatatggatattctgccgatgaattatgaatagtccgcccatctgccatcagatagcaatcaattaccctctgcggcacagacattgaaccccatccgccaaacttgacagggaatgagtgatgggtatagttagtgacgttactggattccatcgcccagatgaattctttattagtctgtatgataccttctcctgtgaacatgtcggagtaagagtgataaggatcgatattgcctgctccgtcagggaagttagcagtagggacattggaggccagaggatatgggttctgggcatctgcttccactgtatgtagctcgtatcccattttggtcagctgtttggcggcagctgctgcaacggcccagcgtctcgggtcatactcttgattgacatagtaggctccgtcgcttttacgtttccaggtcccgaaacatttacgggctgcagctccgccattgaaaagcggtgaagcctggaagaggcgcaaacgggcgatgagtgccatggctgctcctttggtcggacgttgataatagttgacgctttgctcatccgccgaatagatgccttgagttgccagtcggaattcatcgcatatataatctacagactcatcataggtagcccgttcgcgattataatattcggcaggttcggaggtgctcagttcttcatcgcccacgataatcaacggtccccagttcatcaaaagatgataataagcgtacccacgcataaagtgaacatatccgatataacgtcttctgtccatttcgttcatatcaggtacattgtagacttctttaagcattttgttacatcttgctacaatgacatacatgtcgtaccattggttttggataggcagatttctgctgttgatggtacctacggaaaattgtagtccccaaaattcatttgtctgatatttaagtgttatttcgtccgaagcagattcccccggattccaggaatttccccagatagcccctgcgtcgggaaaacctttcggagtgttccagagataaccttcagcatttttcttgctgtgaaagatggagtcttctttgaaagtagcttcgaagtatgggtctacatccagaaaattgcaggaactgagtagtagtgtacttcctactgttgctcccaatattattttgaataactttttcatgagtgttctatattatttttagaatttaagataaacctggaacgtgtaagttgccggtatcggataagcggccccgtttgcagatgcctgttccggatcaaaatacttcactttgtcgatagtaaaaaggttgttggcaacaaactccagatcgacagaagatagtcctgtcttttttatccatggagtcttcaggttgtacttcagactgagttcctgaaagcgcaggaaagaaccgttccgtttccagaaagaggaaagctgggagttgttcgtattacctccgtaggagagacgtgggaattctgcatggggattttccgtagcggtggtgcctgaataccatgcgggcgtccatctgttcttgggattgttggccagcttgataacgttgccgagttctccgttatagaagggaatccatcctgcgtcattaccgagtcccgaacggtagtagtctacttttgccgaacctttgaaaaggaagctgagggttaagtctttccaatgaaaatcggctccgaacccatacattacccgggggagttggttggaataagacaaaggtactttgtcattgtcattgataataccgtctccatttacgtcacgatatttgatatctcccggacgaatgcggccgaatccgctttggtcggcacttgtgttgatttcttctttactggagaagagaccttctgcaatatatccgcgaaggatgttaaagggttttccggttacactcagataatcataaggtaacttgttttcttcatagtaatcaataatattctgagagaaagtgtaattgccgcgtacagtgaagctcatgtctttattgatctggtggaagaattcgaagtttccgtcagaaccatagctatgcatttttcctacatttgatttcgggacggtaaccatacctacaaacttaggcagcgtcacacgatcctggaagatgtgatcacgtgtatcgcggaaaaagtcaacagtgacagagagcttgtcgtggaagaacttggcatcgataccaaagttgagtttctttgctacttcccattgaaggttgtcggctcctttcacagtttctgtaataccccgttcacgatatccccagtaagaggcggcattgtcattgattaatgtcaaataagggaaccggtcaccactgatctggtcattacctacctgaccgtaggagccgcggaacttgaggaagcttaaccagggaatggcctcattgacccagttataggatgtcggtacccagcctacagcaatggaagggaagaagccgaatctttttcctttttcgaattgtgcagaacctgtgtaaccgaagtttgcatcaatgaaatagcaattgttatagccataggaaacacgtcctgataagttttgacgccgttgaggaatggcattgatacccatcgcgtcatacttccattgggtgttatgaacatcttccatgtaatataaagccaatgctcctagtgagtgcaaaccaaatgtacggtcccagttggctttggcttccatgtagtattttctgtatctgttgttattttgtgtatatttcatgttctctttggcagtacgtaatgttttgatgagtaccccttgtgaacttcttcctgtagcgcggtagaggtcaggccatatgtaacgtccttcattgaaataattgatattttcgctcatcgcttgtaccgacgctgtcattcctttcaggaatcctccgaatttctgttcaagtttgagtgtaagcatattacgctgagtttcatcttgcgtgtatccggtgttatttagcatgacatacggagaagcaaggtcatgttttccataagaagggaaggtaccgtctgaataggttttaggaaacatcagtggagttagctgacggactgctgaccataccgtattcgtgttttgtccacccgggctggtatagttggaaatatatccgtccagaccaaaataaactttggttgttttggtcagattcatgtcaatattggcacgatatgttatttttttatatgacaaaggctttttgaacaggttgtcttcctgccggtaggccgctccttcatcctgataccctaatgaaagataatatctggctatgtcgcctcctccttgtgcattgatgtaatagttctgttggatagatgtgcgtttcattatttcatctatccagttaacatccgggtagaggtctttatccaaattgtattttatcagatccagttccagacgggagtaaaggtcgtcttcacccgacatggcacgtgcctcattggcaaggagagcgtagtcataagctcccaggtattcgggcagacgtttgatgtgcgatacttttaatgttgctcgtcctgtgatggtaagtttgcctgtttctccacgtttagtggtaaccaagaccacgccattggcacctcgggtaccatacactgcggtggcggaggcgtctttcaggatactgaacgattttacatcatcaggatcaatgtcttcaaggcggccttcgataccgtcaatcagcactaatgcaccggagctggctccgaaagtactgataccacgaatccagaagttggagatgttttttcccggttcgcccgaactctgcatggtgatgacaccagccaaccgtccgccgatcatgttgttgagggaagtaccgggagtactgagctgggctacatcaatggtactgattgcacctactactgatatctttttttgtgaagtcatacctgtgaccactacttcgtcaagcttggtgtcatcttcttccaatgtaactttgagtgtcatttcatctttagtcaccagtttctcgatagatttcattccaatagcctgaatgactaatatttggttggcatctactttgatactgaatttaccatccatatctgctgaggttcccactcccggtgcattcttaacataaatggtagtacccggtagcggttcaccggttttgtctattacgacccccgctacagtaaactgttttttcttattgtcttgactgtaactcgtcagcggtataagcgccatgatcagtacaatcagtagaaaattatttctcatattgtattttgtataaggttattcaatggataatttacgaatcactttgttctgtgtgtcggctacatatacaatagttccatcactgttgactgctactccgcaagggaagtggaatttggcaatttccggacctccatccttataaccttccgctcccggcagaccgataggtgtggttacggctgctctttctttcggcatagtagtatctattacgcggatgcaggaattaccactgtcagcaatgtacatttttccgtcgtcggtgaaacaaatctggcgcgggtgtctgaatttggcgttcttcagcaagccgtcttcccagcccttcccattcataactccttcgtagattgcttttcctgcgtatgattctccgttataagtgtctttatcttccggagtgatcttggatacgtccactctccaaatctggtgaaaatctgcaagagatacatagagtacgttttcttctcctttaatagggctgaatgcgatataggagtcacttcctgctttgccgccgtcgcctgttgctacattagatattttctttagcaaaatttctgctgtacggtttttaggattgattcgaaccaattgccctttccacatgaccgtatagatcatatgatccagcttgttgattacaaagcaatgcttccagttgttttcgtctacggtgctgagttcttctgatttcaagactgttctatatcggggaacataatttagaagtttttgcatatcataatatttcatgccggcatcatccggaatgtaaacagcttcagcatctttttcatcagaataagccggtgcattaatatatgcagttccatattttaatacaatggaagaattgctggcgatggaaatcattgaaatgtttccgtttacgccttcacctttttcattacggcaggttgtgtttggttgtttgtcttttccactgtctcctttacggtctaccacaaatatattgtcttcaccgtctatacagagatagaaaggagaggagaaagtacatgtggcaaggtcaccaccaacggtgtttatattattgtccggtgatgcaagtcctgctaccgtactaacactggtttgtgtcttgtataggaattggtctggtgctttgcctatgtattcttgaccgtcgggcgttcttctttctacaagaatattcatctctcttttgaaggtgagtcctttgggaacaaatgcatagattctgctaccgttactgctgactaatccggcaggatgtctgatcccgtctacatcttcaaaatagactttcatgccagtggtgtctgtaccgaagttgcggccttcgatgatcatcggagtggctatacctccggaatcaggataaaattctgtaatctcaataggctggtttgggttgaacccgctgcttccattgatgtcgtcatctgaacaggaagctaaccacgcgaaagctgtaatgaacagcgtccaataaactcttctttttcgcattgtttttctgtgataaaaggttaataattagattggttaaaaaaaagtgatagggaaacctactcttgtgtgtctactatgtgggtagaactagggtatgcatacaaggggtatacgtttgtttttgtatgtatgagtaagtttgaaaatatatgggtgtgtttgactgctattattcatcttcttaaattgggggtattgaagttgataatgaactcagaatacatatcatacctattctgatctgtgctgaaataaaagtaaaaaatgagatcaaattctccggttttgaaaggcggagggctgttgctaagagttttcataaatgttaatttaaggttataatcatattgattaattggggctaagtcgtaataggacttggtatatgtgcgtataagtgccttatatataattgattaattggttgatgaatgcttgggatgacaaattatgaactatatagtagaattgagattctaaaaaaaaggtgtttgttgataattaaaataaaaaagatattgtatttttcgattttattaataactttacaccgtcttagaatagtacatgtacttaataacctttgaatagcctatggaaacagtagaaaatatactttggggtataaaaataccaagtcctattacgacttcttcaaaattattcaatttggcataaggtctctattgctctccaggatgaaaagtaatgcaattaatttaaataattaggtcgatttttcctttgaaaataattagaagactgttcttttgagttttttctaccttatatatattagattgttctacccaaacagtcaatctcttaaagtagtttttgagcatccggaatcaggatctcttttctgtgcaactcgattaaaccattatcctgtagttcattcagtgttttagaaatatttaatcgagtatcatccagacaacgtgccaaatcgtccatctttactttgaaagtcttttccccttgcggtttttcgcaatgtgacagaaagaaacggataattttgctttttaaatccagcgtgggttcatcccataaacgggaatagagattttgcgcccggttgctgacgatattcatatagttgaggcggaagatgtcatatttgaacagatcactgagtacgaatgctttgctgatgcaaacagtatgcacttccgtatgtgccacataagaagaggcatagttggtattcataccgaataaagactgaggttctatcagatagggagcttcgatttgttcgatgaccgtataaatgttttcttttgcattggtgacaatagaaatctcacctttcaacagaaaacaaagttgggtacagggattaccactctttatgatggtttccccagctttatgtttgataaagtgcagcttgactttatccagaatactagtgaaatcttcatgacaaagcccctgaaataaaggtaattggagcaaagtatcgaacattgtttccatacgttgtaatctcttattaatcgtacaaatttactcataatacaacactgctatccacatatcccctttctttttgttttttttattgtttgaatgcataaaaatagagtatatttgcaaaaaaaaggaggaattatgttcacgggttttaattggcagcaaatggtcagtgcgtttatcgtactttttgcagtaatagatattatcggttctatacctattattattaacctgaaggaaaaggggaaagatgtgaatgcaacaaaggctactgtcatctcctttgctttactgataggcttcttctacgcgggtgatatgatgctgaaactttttcatgtagatatcgaatcattcgccgtggcgggcgcattcgttatttttcttatgtctctggaaatgattctggatatagaaatcttcaaaaatcaggggccgataaaggaagcgacactcgttccgcttgtcttcccgctgctggcaggggccggagcttttactacgcttctttcgcttcgtgccgaatatgccagtgttaacataatcattgccttgatactgaatatgctatgggtctactttgtagtaagcatgaccggacgtgtggaacgtttcctcgggaaaggggggatctatatcatccgtaagtttttcggtatcatcctgctcgctatctcagtaaggttgtttactgctaatatcactttattgattgaggcattgcataagtcgtaaccgggatttatgaggtaatatccgtagagtcggttgtattgcgatcgttgatatcttcttccggagattcttcttcttcatccgtttcgtccgcaaaaggttctggtcgttgaggcccgtggttcaagaaaccgaatgcacagagtgttcccatgatacccccgctgagatgtccttcccacgacatattggcgggagagaagtaggggaacatatgccagatgattcctccatacaaaaaggtgacaagcagtgagatggcaatcagaggaacatatttccgcaggataccactgaaaaaaagaaagaaggcaagtccgtaaatcagtccgctggcaccgatgtgccatcccggtttgccgataatgaaggtcagcagtccggctccgatccagatgatcataaaaatacgtccggctatccccctgtagaaatagaacaagcaccacgataaaaaaaatagcggcaacgtattggccagcaaatggctgaacccgctgtgtatcagcggatgagtcagaatacccgttattcctcgcttttccagagggtatatccccatgtgagagaagtcccagcccatgccgacttcaacgatctttagcagaaataggataaaaattaggaacaacggcaccgctgtagccagcatgatacgctgaatatctcgcttcattactttcttttctttagatattttacgcaatactacgaatatttgcacaaaaactgaaaataaaaagcctttttatttttgtttttatctagaatttgtacatttgggcattatacctatatatacaatgctcaggctggtatatatacagaacagcaatagatatatataaggaatatagtgaccaataattaacctttaaataatgcacaactatgagttatttacgatttgacaagaccctcatgacgaatctggaagaaagtctccaaagggagattctccggacgaacaaagcaggagcttatcattgtacaacgattgttgattgtaacacacgcaaatatcacggactgttggtaattcctgttcccaatatcgacgatgaaaatcatgtgctgctatcttctcttgatgaaacggtaattcaacatggtgctgagtttaacttggggttgcataaatatcagggaaacaactttagtccgaatggacataagtatatccgtgaattcgattgtgagcatatcccggcgacaacttaccgtgttggaggagtagtgttacgcaaagaaaaaatctttgtacatcatgaaaacagaatcctgattcgttatactttgttggacgcacattcggcgacgactttgcgcttccgaccgttcctcgctttccggagcgtgcgagagtacactcacgagaatgcgcaggcaagccgcgattatcagcttgtggaaaatggtatcaagacttgtatgtatcccggttatccagaactgttcatgcagttgaacaaggcttgcgagttccatttccagcccgactggtatcgtggattcgaatatccgaaagaacaagaacgaggctatgacttcaatgaagacctatatgttccgggatattttgaagtggatataaagaaaggagaaagcatcgttttctccgcgggtacttccgaagtgactccgcgcagactgaagcagacgttcgaagccgaagtggctgaccgtacgcctcgcgatagcttctatcactgtctgaaaaactcagcacatcagttccacaaccagcaggaaggagaacattatatccttgccggttatccgtggttcaagtgccgtgcccgcgatatgtttatatccttgccgggactgacacttgcgctggacgaggtggatcagtttgaagatgtgatgaagacagcggaaaaagcgattcgaagcttcatcaatgatgagccggcaggatacaagatttacgagatggaacatccggatgtactgctttgggccgtatgggctttgcaacagtatgccaaggagacctcccgcgaacaatgccgtcagaaatatggcgaactgctgaaagatatcatcgaatttatccgtcagcggaaacatgagaacctcttcctgcatgaaaacggtctgctttatgccaatggcaccgataaggcgattacgtggatgaactccaccgtaaacggacatccggtgattccccgtacaggatatatcgtagaatttaatgctttgtggtataatgcgcttcgtttcgttgccgatctggttcgtgaagatggaaacgttcttttggccgatgcgcttgacgcacaggcggaagtgacgggaaaatcatttatcgaagtgttccgcaacgaatatggatatttacttgactatgtagacggaaatatgatggactggagcgtacgccccaacatgatatttgctgtagcattcgattattctccgttggatagggcacaaaagaagcaagtgctcgacatagcaaccaaagagttgcttacccccaagggactccgtaccttgagtccgaagagcgggggctataaccctaactatgttggtcctcagatacagcgtgactacgcttaccaccaaggcacagcctggccttggctgatgggattctatatggaagcctatttgcgaatttataagatgagtggtctgtcgttcattgaacgccagcttattggtctcgaagatgaactgacaattcattgtatcagttcgttgcctgaacttttcgatggtaatccgccttttaaaggacgcggagctgtatcgtttgccatgaatgtcgccgaagtactgcgtattctaaagctactgtctaagtattattaaaaagaggaggaacgaaaatgaaagttttaatgtttggatgggagttccccccgcatatcttaggagggttagggactgccagttatggtctgacaaaaggaatgtctcagcaggatgatctggagattacattctgtattcccaaaccatggggagacgaagatcagagctttttaagaattatcggcatgaacagcacgccggtagtgtggaaaaatgtcggttgggactatgtgaaaggacgcgtaggcagttatatggatccgcaattgttctatgacttgcgcgatcatatctatgccgacttcaactatctcaatacgaatgatctgggatgcatcgagttctccggacgttatccggacaacctgcacgaagagatcaataactattcgatcgttgccggggtggtagcacgtcagcaggagtttgatatcattcattctcatgactggctgacttatccggcagggatacatgccaagcaagtatctggtaagccattggtgatccatgtgcatgctactgatttcgaccgtagtcgcggcaatgtcaatccgacagtgtatgccattgagaagaatggtatggacaatgccgaccacatcatgtgtgtgagcgaactgacccgtcagactgtgatccataagtattttcaggacccgaagaaggtgtctactgtgcataatgccgtttctcctttgtcacaagagatacaggatattgttcctcaaaagaatccgagcgaaaaggtcgttactttcctgggacgtattaccatgcagaaaggaccggaatactttgtagaggctgcagcaatggtattgcaccgtacgcgcaatgtccgtttcgtaatggccggtagtggtgatatgatggatcagatgattcgtctggtagccgaacgcggtattgcggaccgtttccatttccccggttttatgaagggaaagcaggtgtacgaagtgctgaaagccagtgatgtatacattatgccttctgtatctgagccattcggtatctctccgttggaggctatgcaatgtagtgtaccttccattatatccaagcaatccggctgtgccgaaattttggataaatgtattaaaacggactactgggatattcacgctatggcggatgccatttattctatctgtacttacccggctatgtacgagtacctgaaagaagagggtaagaaagaagtggatgagattaaatgggagaacgtgggatataaagttcgcggtatctatgatgaggttattaaaaattatggtaaacaataaaatgatatagactatgagaacgatctgtctttatttcgaaatacatcagattatacacttgaaacgctaccgttttttcgatatcggcaccgatcattattactatgatgactatgcaaatgaaaccggtatgaatgaggttgccgaacgatcttatatacctgctctcagtacgttgattgagatggtgaaaaactcgggaggagctttcaaagtggcgctttctatttccggtgtggcattggagcaacttgaaattcatgctccggcggtgattgacttgctgcaccagttgaatgataccggctgttgtgagttcctttgcgaaccttattcacacggcttgtcatctttggctaacgaagactgcttccgtgaagaagtgcttcgccagcgtgataaaatgaaacagatgtttggcaaagaaccgaaggtgttccgcaactccagcttgatttattcggatgaaatcggtggactggtagcttctatgggctttaagggaatgctgacggaaggtgcaaaacatgtattgggatggaagagcccacactatgtatatcactgtaatcaggctccgagcctcaaattgctattgagagactttaaactttctgatgatataggattgcgtttctccaattcggaatggccggaatatccattatttgctgataagtatattaactggattgatgcgttgccacaagaagagcaagtgattaatatctttatggaattaagtgcattgggtatggctcagccgctttcttccaatatcctggaattcctgaaagcattgcccgaatgtgctaaatcaaagggtatcacgttctctactccgacagagattgtatctaaattgaaatctgtatctcagctggatgttccttacccaatgtcatgggtggacgaagaaagagatacaagcagttggctgggtaatatcctgcaacgtgaggctttcaacaagttgtatagcgtagcagaacgtgttcatctgtgtgacgaccgtcgtatcaagcaggactgggattatctgcaagccagcaacaatttccgtttcatgactaccaagaatacaggtatctggctgaaccgtggtatttatgactctccttacgatgccttcactaactacatgaatatcttgggcgactttatcaaacgagtagattcactgtatcctgttgacgtagataatgaagagctcaactctctgctgactactattaagaatcagggtgaggagatagccgaactgcaaaaggaagtaaccaaatggcaggcaaaagctgaaaaaggagctgtaaaagctcccaagaaagtagctgcgaaaaaagaaccggtagctaaagctactcgtaagaaagctactgcaaagaaagaagaataagataataataaattaactggttgtaaccgtggggagatgggaatcacctcacggttgttttttatatattggaaggtacaggtacatataaaaaaacagcgcgaattaccgaagtaacccgcgctgtttattttatatatctttttagtttgacttagttgttaatccgaagtctgtagaaataacttcaagtttcaacttgtaatcaggatttgttttgcctagacttccacctttcagccgtacataacctggttttaaatcatgttgtattctaataatattagcttgaccagttgtagtatttgaagagtcataagtcacaagtacaggtataaggactactttgttccaatcagggttttcttgtaaccatttagtttcatcccatgaactaccagcattctttttagcctcttccttttctgcaatacaagcatttaccaatttggtgatgttgctgaatacatattggttcgtgctacttgtgtgtgaagttagataagaagatacaccatcgctcagcttattgtctttaaagaagctatcctggaatttcttacgtacaagcattacagtagatggtatagccataccaaacttcttatcacctgtttgattgtaattagtgaatgtcagttttactgcatttaaggtatcgcctgtcaattcattttgtatatctgaaatgggtagtgtagcttcggtgaaaatacctgccggactctttaaataagtgtttttatcttccttaattaatgcatctatcctttcgggatcattctttaattgattggcttggattacttcacgagttgtagcaaacacacgataagagtaataagtagagtccttaccacttccgtctttcttctgtaatttttttccggtaatagaatctgttgcatagcatttgtatactacattcatttgtggctgatctatatagagtacagttccatcaccatagtcgctcttaacgtagattccttgaaaagcttctctgaataattggctattgaattccttatcagcatttttagcttttcttgccgcagttaaaatatttccacctactcttgttgctatatcctctttgaaagcaatatgcacacttggaacatatgtgcttaggttacgaatagaatcttttactgaaagatctacggctgtatatgctttggttcctaatatattctgactatcgtaaaaatcctcagggttaatatcggtatagtaagcattatcaagatttaatgtctctttcccattgcctcccagttcatatacacttaatctacaagctgtcaatgagtctccaaagtagctgtcataccacaggtagagttcgactgcacgtatgtttcctatgatttgatttccgtcttttataaaagtaacatctttattttctggatctttatcatcgacaaccattcttcctgtggctgaaataacattaccacttgcatctgtaacttctttgtatggttcaggaaaagttagtccatccggacaatttagctgagccaagaatccagcctgataagtgccaaatgtttcatcagtgaatttgccaatataaccgatgttagttttcgcataaatgtcacctgtcttaacagattcagtagttacatcaaacgtggataactttcctttgatattttggtcattgcccgggaacattcctaatcccagtccgcctgtattatcatcgcatccgaaaaatgtgattgccagtaaagctatcaaggcatattttgctttcatgattgtcgtatctagatttttattcttcttctttatttgtagtggtttcccatacctgatcgtagaattcgttgcaagcgtttgcgtagttttccggatcctgataatcaagtaccagtttgcctgattggcgggcgtactcaatgattgattcgtctacctttgcgctgttttgtatgattccgtcagaataatcaacggcaagtttacaaagtgccgcatagtctaccggttccttcaaaccagccaaatccttcttggtgatgcctttcaacatcagtttggttgcaaaatcttcactgagcgtattcttgaaatcatcttcatataccgagaatacaactttggcatcacggaacgatggttcgtccttgtaggccttcttaatataaagaggagccaatgccgtcatccatccgtgacagtggataacgtcgggacaccagcgaagcttcttcactgtttccagcacaccgcgtgcataaaagatagcacgactgtcgttgtcatcgtattccacaccattttcgtccgctgtctgcaagcgattctggaaataatcatcattatcgatgaaatatacctgcatacgtgcggattgaatagaagcaacttttataataagggggtgatcagtatcgtcgatgatcaggttcataccggagaggcgaattacttcatgcagttgatttctgcgttcgttaatgtttccccatttaggcataaatgtcctgatttcacggcctttttcttgtattgcctgtggaaggtttctacctatattggccatttcggattctgaaacgtaaggtgtaatctcttgagtaataaataaaactttattcgcctttgtcataataacaatagttcactataatattctgcaaagatagcaaaaaaaaggaactttaaataccatattctttctttatgtggcaaatattagtttattttgcagagtttttgcaaacgaccaaaacataaaccaattaacaaaaatgaaagtaatacacactatcaaggacttacaggccgaattgacggcactgagagcccagggtaagaaggtaggactggtacccacaatgggtgctttacatgcaggacacgcatcactggtaaagcgcagcgtaagtgagaatggtgtaacagtagtgagtgtttttgtaaatcccactcagtttaacgataaaaacgatttagcaaagtatccgcgtacattggatgctgactgccgcttgttggaagattgcggggcagcatttgcctttgctccttcggtagaagagatgtatccacagccggatacgcgtgaattcagctatgctccgttggatacggtgatggaaggggctttccgtccgggacatttcaacggagtttgccagattgtcagcaagttgtttgacgcggtgcaaccggatcgtgcttatttcggagagaaagatttccagcaactggcgattattcgggagatggttcgtcagatggattataaactggaaattgtaggttgtcctatcgttcgtgaagaggacggattggctctgagcagtcggaataaacgtttatcagcacgagaacgtgaaaatgctttaaatatttctcagacattatttaaaagtcgtacctttgcagcatctcatacagtgagtgagacgcagaagatggtagaagaagcgatagaggatgctccgggattgcgtttggagtattttgaaatcgttgacggaaacacgctgcaaaaggtaagcagttgggaggattctctgtatgtagtaggctgtatcacagtgttctgcggagaggtcagactgattgataatatcaagtataaagaaatctaaattaaaaaaagacgaaaccttatgatgattgaagtgttgaagtcgaaaattcattgtgcacgtgtcacagaggcaaatttgaactacatgggtagtatcacgattgacgaagacctgctggatgctgccaacatgattccgggagaaaaagtgtacatcgctgataacaacaatggcgaacgctttgaaacctacattatcaaaggtgaacgcggttccggtaagatttgtctgaacggtgctgccgcccgcaaggtgcaaccggatgatattgtgattatcatgtcgtacgcattgatggattttgaggaagcgaagtcgtttaaaccgaccgtgattttcccggaccctgcgacgaatagcgtagtgaagtaagaagtatcttgtgataagaaaaccccgtttgcattcagcagacggggctttctgttataataagcttgtccttttacttgctttgcagttgttcattcatggcagcggcggctttacggccatctcccatggcaaggattacggtagctcctccgcgcacaatgtctccgccggcatagatcatcggaatagatgattccatgttgtcatctacggcaatggttcctttgcgtcctaattccagtcctttaatggaactcggaacaatcgggttcggagatacaccgacactgacgatggccagatcgatatcgattgtttccgtagctcccggaatggctacaggactgcgacgtccggaagcatccggctctcctaattccatcttctggagaatgacctgtttcacgcaaccttgttcgtcggcaatatattcaatcggattgtgcaatgtcaggaattcgactccttcttctttggcatgcttcacttcctcgatacgtgcaggcatttcttcttccgaacggcggtagatgatcatagcacgttcagcacccaggcgtttggctgtacggacagagtccatagcagtattaccaccaccgatgacagccacatttttgccgaaagctaccggagtgtcagagtcttcgctcgcagcatccattagattgacacgagtgaggtattcgttggaagacatgatattgatcgagttttcgcccggtatattcataaagttaggcaaaccggcaccggaagcgacaaatattcctttaaaaccttcttccttcaaatcttccacactgattgtttttcctacaatgcagtctttgatgaaagtaacgcccattttaacgaggttgtctatttctacatctacaatcttgtttggcagacggaattccggaataccatattttaatacaccgccgatttcgtggagtgcctcgaatactgttacatcataaccgtattttgccatatcacctgcgaatgataatccggcaggacccgaaccgatcaccgccactttgatgccgttcttttcggcaatgacaggtactgaaatttgtccgctttcacgttcgaagtcagcagcgaagcgttccagataaccgatagctaccggtttttcattcatcttcaagtgtatacatttggattcgcattgcttttcctgtgggcagacacgaccgcatacagccggaagcgcacttgtctctttcagtgttttggctgcttcgaggaattcgctacgctcaatgttcttaatgaagcgcggaatgtcgatacctaccggacacccttccatacatccagggttagcacagtccagacaacgcttggcttctgtaactgcttgctcagcggtcagaccctggtttacttcttccttgcggctatgtgaacggtattcggcatcgagttcgttcatctcgacacgtggaatagctgtacgttctttcggtttcatcgatttgcgcagttcctgtctccaggctgcgttgcggcttttctcatctatctctttcgttgcttcacattcgggctggagtttgttcatctcttcacgctcaatttttttgaacgcacccatacgtttcagcatttcatcaaagtccacctgatgaccgtcgaattcgggaccgtcaacacaaacgaacttcgtttttcctcctaccgtgatacggcaagcaccacacatgccggttccgtctaccatgatggtatttaatgaaacgtcggtaggaatctcatatttctttgtcagcagacaaacgaacttcatcatgatagcagggccgatggcgaagcatttatctaccttttcacgtttgatgacttcttccacgccttcggttaccagacctttacgcccgtaagagccatcgtccgtcataataatcacctcatcggagctttcgcgcatttctttttccagaatgataaggtctttgttacgtcctgccaatacagtgatcactctgtttccggcagctttcaaagcctgtacgataggaagcatcggagcaacacctacaccaccaccagcacaaacaactgttccgaaattctcaatatgagtagcttgtccgagcggacctactacatcagtgatataatcaccttcgttcaattcacaaagacgggtagaggagagcccgacttcctgtatcaccagagtgatggtgcctttcttcaaatcagaaccggcaatcgtcagaggcatacgttctcccttgtcgcctacacgtacaatgacgaagtggccggctttgcgggatttagcaattaaaggagcttcaatttcaagtttaaacactttctcagaaaagcgttctttgctaatgattttgttcattatctaattaatttgttggtattattacgtaactgctatcagaatgttataaatttcggcaaagatacggcttatttacgaaatataaaaagaaaagtcactcttttgatgagtgactttccatatccatgtgaatatctttatttatttcgttctgattttgtatccggctaccccataatatagaataaacaggaagcagggaaggcaaatccaatatgctttctgaatatcggaaatgtctttcagatagccaaataaggtcggaataacagcaccgcctgccattgccatgatcagaagagatgaaccggatttggtgaactttcctaaatctgccatagccaaaggccatagggcaggccacattaaagaacatcccaatgccataaatgagatgaaatagatggatatatcggcaggtgtaagtactactagtacggaaccgatgatagccagcactgaacaaatcttcagtgctgtagcctggctcatatatttagggatgaagatgatgccgcagatgtaaccgatcacaatgcctatcggggcaatccaggcatacattgctgcattttccaaatgaaggctggtggcataatctactaatgtacccagtgatacggtttctacacctacatataagaagagagcaagacatcctaataataaatgcgggaattgccagatggaggttttctttgcggcgtacggacaggcttcggctgcctcttcgctgtcgtcttcaccgacggctttgacttccggtaggggagccatgtatgcgataatacctagtgcgatgaatgcggcgataataacgtagaatggcagaaacaggtcagctactgtaatatcggtcacttcttttccgattaggaaagccaggaataaaggaggaatcggccatgcgagtttgttgcatatacccataatgctgatacgtttggcagcactgtctatcggtcccagaatcgtgatatacgggtttacagcagcttgcagataagcgttggcacttccgctgataaaggaagccaataaaaacagaggaaaactttcataacttgccgatggtatgaaaagtccgaaggctatggcaaacataaggaatgaaaggaccattgttcgtttgtatccgatttttttgattgtaaggcctgccggataaccaaaaataaggaacgggatgaaagtggcggcaatgatcagatatgattcggccgaactgatttccagtgatcccttcaatacggggactaatactgagttgataccaagggcgaagcccagtgaaaagaacataacgccaatgaatgccaatggcaatacgaaactttttgtgttttttgtcatggggtaaatgtgttaaaggttaataaaggaaactcctgtaaggggcagagatatctcatccttacaggagtagaaagtttcttagtctatcatgtcgaaaccgcagtatggaaccaatgctttaggaattctaattccttcgggggtttgattgttttccaataaagcggcgacgatacgtggtagtgccagtgctgatccatttaacgtatggcagagttctgttttcttttctgcactacggtagcggcatttcagccggttggcctggtaagtgtcgaagttagatacggaacttacttccagccagcgtttctgtgcttcggagtatacttcgaagtcgaaacaaagcgcagcagtaaagctcatatcaccaccacaaaggcggagtatacggtatggaagttccagtttctgcaacaggccttctacgtggtcaagcatttgctggtgggattctttagaatgttccggcttgtcgatacgcactaattctactttggagaattcgtgcagacggttcagcccgcgtacgtctttaccgtaagaaccggcttcgcgacggaaacattgtgtgtatgcgcagttcataatcggcaactgtttttcttccaggataacatcacggtagatgttagtgacaggtacttcggctgtcgggatcagatagagatcatctacttcgcaatgatacatctgtccttctttgtcgggaagctggcctgtaccataacctgaagcggcattgactactgtcggcggcatgatttcagtatatccggatttgcgtgcttcgtccaggaagaagttgatcagggcacgttgcagttgggcaccttttcctttgtatacggggaagcctgcacctgtaatctttacacctaggtcgaaatcgattaaatcgtattttttagccagttcccagtgaggcagtgcatctttgggaagttctgtttccatgcctcccatcttttctacgacattgtcttcggcacctacgccttcgggtacgctgtcataaggaatgttggggatcgtataaagtacattctgcatgtctgtagcagcctgtgtcatggtagcgtccagcgctttgttgctttctttcagttcggcaacacgtgcacgtgcagcttcggcctcttctttctttccttctttcatcagctgaccgatcgtgcgggaaagtgaattaacctctgccaggttcttatctaataggttttgcgtagtacgtctcttgtcgttgagagcgatgacttcatcaatcgtctcttttgcattcttgaaatgcttcttttccagtccgcggagtaccgcttctgtattttctgtaatttgtttaatggtaagcatatctatactttttatgaactttctttattaaggctacaaagataaagaaaaaacgaataagcgagcaatgaaaatctgcataaaaaaagaaaggagaagcaatcctttggattacatctccttttcttgaatattttcagttgtacaggttatgcttctgttgcttcagcagggatgatagaaacatatcttctgtcttctctacctactttaaatttaactgtaccatctactaaagcgaaaagagtgtggtctttacccattccgatgttttcacccggatggaattcagtacctctttgacgaatgataatattacctgctttgcaagcttcaccaccaaatatcttaacgcctaatcttttgctatgtgattcgcggccgttcttagaactaccgacaccttttttatgtgccatttcttcttactttttaaatgattaagctactacttctgtgattgttaactctgtgaactgctgacggtgaccgttcagttttctgtaaccttttcttcttttcttgtggaatacaagaactttgtcacctttaaccaagtttgaaataacctggcaaacaactttagcaccttctacagtcggagcacctacagttacgtttccgtctttgtctactaaaagaactttttcaaattctacagttgaaccgttttctgcaccttcaatgtggtgaacgaacagtttctgaccagcttctgctttaaattgctgaccgttaatttctacaattgcgtacatcttatatataatgtataagttagctccggcgggtggtctttaatcacttaaagagctctttatcgaacccgttgcggaataatcgggcacaaaagtacttcttttatttgtttcagacaaatatttcctttatttttttgctgttgtaacagaagataatcagatatatagcaaaccggataaattctccataataaaccggtgcggatatgctctgagttcgtcagcggtagtcattccattaaggacacctgcaaaatctactcccgcattttgtgctgtttcggcatccacagtactgtctccgatgtataaggtttcttgcggagtcctgcccaagtgttcgagagcgaattttattccttccggtgaaggcttggcagcttgtacatcttctccgcctaccactatgtcgagaaagttttccggcagatactcatccagaaaactaagtatacggaaacggtatttagtagagataatgccgatgcgggcacctcgctcttttagttctttcagagtagagagtgtatcaggaaaaaggcgggtattcacgttcatgtgaacatccgcttccagtctgtactcttgtcgaaaagcggtgagctgttcccagtcggtgactccggtcagtatgctgaaagattcttccaatgttttaccaatggtacgtttgatcgcttcgtcagtgacattcgtatattggtgacgattaagtacatttctgaaacaagtaacgataccccgtgatgaatcggctagtgtatagtcgaaatcgaataaataagttttataattcattattttactgcttctactgtatatccctgttttttcagtaagcttaataagcctttattacccggcaggtgcaaagcgccgactgcaacgaaggtaggagcggctttcatgatagccggtagtttctgtgcccatgttttattgcggtcgtaaattagggcatcttcttctgtgggaagtgcatcacattgatttcctttacgctcttcgttgattttcaacatggtttccaaatcttgtttcatgtaggcatctgtcagtcttttgaggctttccacctctttgtcgatgttattgagggtacacatgagcagttgggcttggcgttgcagggaaattccattgtatagcaggttaaactggaaatccggagtttccagtccatccactttttttcctttttgtgttgcctgagtctggaaataagtatcgagctgttcttgcggattatagtttccgatgtgcttgatgtacgccactactgctatgttgttcagtaagaaagccggtttgattttgggtgccatgttgaggtccatcatcaggttctccttgcagaatttattagcggtttcgtaatcttccggtgagaggagggtagtcagagtcgtatcgctttctatcatcatcattttctgcatcttctggatggtggccggagactggatatccgacattttcagttctccatatacctgttgtgtttcatccatcgctttctgtagtccggtaatgccgtctttgacactcaacggagcgagatggtgagtccccataatgtatgaagggctgctaagtccgttaccagatactttccataaaagctgtgcgtttgcgcttaacgctacgcagataaatatgactgctccaataaacgatttcatgattctatatgtttttaagttgataatcagcgtattcttcctccggatatccagtgtctggtgtaatagtcttcgctcagtcgactgacaatcactcctttgctggtactggcatgaatgaatttcccatttttgagatagatacctacgtgagctaccttttttcgggaacggctactgctgaagaataccagatcgccttctcgcaaattccgtttggcgactttggtactttcttttctcaggtcttcggtatttcgcggaacctgagtacggtatactttccggtatatctggtaggtgagtcccgaacagtcggtaccgcgttttgaatcaccgcctccacgataaggaacaccaatccattcggccgattccagatagagtttgtggttatcttccatattgatgtccacgcccagcaggatggaggcgcgtgccagtgcctggtaatccagacggggagcagacgtgcggcaggaactaaggataaagatcagtcctgtcagtatgaagattagtttgaagttcactcccatcggctatctttcttttcgtatatcgtaaaattataagtaactttattcttctacattgaagtagtcttccagttctttttcagctgaattattctcattcataatatcccggatgatgacgccattctccagcagggcaatacgcggacatacatctatcgtatgattcagattgtggctggaaatgattacagttgcattatgctcttcgctgtactttttgagcatatgtttgataatggattgcgaactgggatcgaggaagttgaacggttcgtcgagtatcagcaactgaggataatgaagcatggcggagatgatgccgattttctgtttattaccggctgagtagttacggatcagtttcttttgtccgatcacttctccgctcatcagacgttcgaacggcagaaggcgttcgtccacctcttcttttttcagtccgtacattttcccgataaaatagaaatactcttccggggtaaggtagtctatcagaaatccatcgtcaatgaaagcacctgtgaagtttttccagtcttcactttgactgacgtcaatttcgttaatgacgacattcccattatccgctttcagtaagtcgagcatcaaccggaaaagtgttgttttaccggcaccgttgtttcctaccaatccgagcatatcgccttgattgatttcatagtgatctatgttcacggctaacttttcgccgaatttcttttgaagattattgatgcttatcattgtcttggtatttttatcgtaaatgattaatcggttcaatcgtaaatctcttattggcgactgtctctgaagccttccatattctcgtatctccgtttcatgaaacgcttatagacgtttctgatccaaagcggagaagtcagtgtgaatccaagcccgatggcgaacaggatagagtaggcggccgtttcacccagaaacgcattcaacacagaatacaggatcaacgggataccgaaagctccgaagttgacaaccatttgtatggcgctgttggtctggcggcttgtcactttctcgttcagtgctacggtctgcttattgtaaacagccagttggaagaaacaaaaatagataaaaccggtggtatagaagaaccaggcaaagatacccagtaagggaactttatccattacaatggcgggaatcatcaggacaaatgggacgatctcgccgatagtatagatataatattttgctttcagcagactcatgatggattctttgcgggacattagtccatcgatgtaattgccttcgaaggacatgagttgcgaaaggatgatcatgccgaatacggcaaagttgtaaacacagataaaggtagtcatggtgctcgtgtcataaaggcttgaaaagctcaacaggcaggagaaggcgatgactacaaggagaacattgcgcaatgcacctttgcaacgccggttgcgcaaaagcatttttaattccaaccgcatatattcaccaacttctccgtatcgctcgaagaatttgtattctgaaacatgcttgatgcgggtatcatctacttttgccaattcggcgtagatgaggccggacatgattttgcggttaatcagccataagatggctatgacaagaatggtaccgaggaaacagagaatattcccgttgatatatccgtcgcccaggtccataaagaagtagaacaggggactgtcttcgggaataaaggcaaggcagcccagtccaccgtagaaagcgatggggagcagcacccaccaaatacgttcattgattagtgtgcgacataacaagtaccagtaattgttggcaacgatcaaaagccagatgcctatgagataggtgagtacacctgagataccgaaatatttggtaatggtaatgaaggaaaaggggacgaacataaacaaccagaacaggttgaacagactaagtcccgaacggataagcaggaaatcgatgatccgatttcgtttaaccggcaacaggaggtaaggttttacctcctgcgtcggtgtcttttggaacggaatacgcaagaggaagtcaagtgccagaataaatatcagggcaacggcattcattacatgatatggttcccggttgggaaccatatctgcaaaaccgaatgcaaacgtcgtaccgaagaatatcaggtatcctgcccaaaaagcaaccccgatatatccgaatattttggcaactttgttcttttcatacatcggatgccgtttggaggcgagccgtccatgtttgcgtaattcgttaaatatcatcatactgttggtatgctataaaagtttatttagcttcttcttcaggtacggtcatgatgacttggatttcgttgttctgtttcatcagcttggcaaggaattcctgtacatcttttgctgtgatgctgttgaccaacgtttcatagtcttttgtataatcgatacctgtgtagaaatactcatccagattgcccagccagtagccgttttccttttgggcgtctttgtattttttcagcatatactctttgatcttctgcatgtgttcggcagacggaccttctttggccattttttccaactgttcgatgacgatgcccgatagtttgtctttcttggccggatcggtctggaatacaatctgaagcacgagttgttctttcggatatttggtgaggcttccgctgcagcttacgccataagtaccgccttctttctcacggatttctgcggtgtaaaccatatccaatgcctgatcgaggatgctgagagtaaggttgttgcgtaaatcatatttgcaagtaccgttgaacaggaacatgatggttgccatcggtgtttcttgtttcttggcaaactcgttcttgtattgacctttgcggatttccatcttcgtatctttgaaagtctctttgcgattgatagatggcagaccacccagatatttggcgatcatcggtttcattttctcaacatcaatgtttcctacaaagtagaatgtaaagtcgctcgcatctttgaaacggtctttgtacatttccattacacggtcatagtcgatcttgtccaccatgttttctttcatgctgaaagaacgtgggtgattgccgtacaatgcataagagactgtatcactgaatgcggtcatcggattagcgtcagcattctgcaattcggctttcatgcggttcttgtatgattcgaatgcttcgttgtccttgcggggagcagtgaaagtcagataagtcagctgcatcattgtttcaaagtccttcggagaacaactgccggaaaccgtttctgttgttgcgctcacaccggctcctacagaagcacgtttgcctgcaagtgctttactcaaatctactttgctgaagttaccgataccaccaaccattgctacgctgttgatttgagagatattcagaatctctttgtcggggaactggctgctaccaccaagactggtacctttcatcagaatctggtcagctttgtagtcggttgttttgatatatactttcacaccgttggacagaacaagttttgttgttccgtaaatatctccggctttttcagaaacgatctttccgcctttcggctcttctttcagcaatggttcgttagaaactttgtcttcgtaaggcttcagatcgaaagatttcatttgtttcagcaaagcagcgatttcttctttcgtcgggtattttacaccttccttctccggacctgccaacagtactacctgattgttgtcagtgatcagctgttgcatcacttgattgatagccgctaccggaatgtttggagccagctgattcatcattgcatattcgtattcaatgcccggcatcggttcattgtcaaggaagttactgatgtattcgttgacataagtgtcgtttttcatcttttcgcgttcattgtaagcagattctacgcgttgcagatagttggcacgggcacggtcatattcagtttcggtgaatccgaagcggcgtgcgcgttcagtttcttcgagaatcgttttcatggccagttcgataccatcgattttgctgctggcgtctactccgaaagcatttttggtcttggctacgaagaagtcgccataacctgcacttgcacctgtaaaaggaggattcgcttgctgacggatttctgccaaacggctgttcagcattgtaactcccatgctaatcatgtattgaatgccgtaatagttgattgtattcttcagtgaatccgggaaggcttcgctcttgaagaagaagctgatggaaggagtttcgatttccttgtccgtaccgataaagatttgcggttcctgattgtctgctaccggatagtagatacgttcagccggattcaccggagctttcacgtctgcaaatacctttttcagctttgcttccatttcatctacattgatgtcgccgacaatcatgataccttgcaggtccggacggtaccatttcgcatagtagtcacggatgtcctgataagggaaattgttgattacatcgaggcttccgattggcatacagtctgcatatttggaatccggatacatgacaggcagggcattggtcatgatgcgctgcataccactgttacggcttctccattcttcacggatcacaccacgttctttgtcgatttccttgtcggcaaggttgatggcgcttgaccagtcgtgcaggatcagcagacaagagtctactacactgacgttgtcggtaggtacattgctgattcggtatactgttttgtcgatactggtgtatgcattcaggtttgttccgaacttgatacctttagtctcacaccaaggcacgatgcccagtccggtttcatcacccgggaagttttttgttccgttgaaagccatgtgttcaaggaagtgagccaaaccgcgctgttgcggctcttcaaggatggaacccactttctgtgcaatgtgaaattcgacgcgtttttctgggagtgcgttgtgtcggatgtaataagtaagcccgttgtcaagtttacctatgcggacatttttgtccacgggcagtgtttgcataggttgtgcaagcacgagttggaagttgcagcatatatagagaactgcaataaaaaatccacgtaataaatgtttcatgttctatttagtttataaaaaagttgtttgaaatatctgtcgtattcttttgtgtataatcacaaacgggcagaaaaaagagttatttgatagcttcccgtattctgactaatttcgttaatagtccttccagaaggtccagcttcaacatgtttgctccgtcgctcttggctacggcggggttttcgtgtgtttcgataaagataccgtcggctcctacggcgatgccggctttggctacggtttcgatcagttggggcataccaccggtcactccgctggtctggttgggttgctgcaatgaatgggtgacatccagtatgaccggataaccgaacgtttgcatttccggaatcccccggtagtctactacaaggtcctgataaccgaaggttgttccgcgttcggtcagcatcacgttcttgttgcctgcttccaccactttgtcagcggcaaactgcatggcgagcggagagaggaactgtcctttcttgatgttaatcgtcttacccgttttagcagcagcaaccagtaaatccgtctgacggcaaaggaaagccggaatctggagaatgtctacgtattcggcagccatctcagcctcgtcggccgaatggatatccgtcactgtgggcactccgaaagtatcatgtacctttttcagcactttgagtgccttctcgtcaccgatacctgtgaatgaatcaagacgcgaacggtttgccttgcggtaagaacctttgaatacataaggaatctgtaatttttcagtgactccgaccacacgctcagcgatgcgcattgccatctcttcaccttctattacacatggaccggccagcagaaagaagttaccggcaggattgttcttaagttcgatcattttattaattacaagttactaattacttatttatagtttcatgagtgaagggctgtttttcgccagaagcccggttctgttggctaattcggaataatcagggtcgtcttttctgataatacgcctatttccagtgggaaatgtcttgccagcaggcgaccgtccagatcgacggaagcattttgtgcgcggagcacttttacttttcttgtccgatagcttttcaccatcttatggttcaggattcttccctgaatcagcatccacaatcccgaaatgatttgcaggaattccggacggtagatgacggatacatccagccagccgttgtagggtacggcactcggagtctgtccccagccccaggcgcttcctacacatacggtcatgatgcgcccgcggatgtgctcgtcattgatacgaaggtgcatccggtatagtttgcgttcgaatatcagcgagaagagggcggcaacgtacgacaggaatttcaccccccagaaacgtttggtctggtcggtgattttcacaatccttgcgcctagcccgatgttgactgcattgaggaaataacggcgttggtgttccttgccgtcgtagaagttgcagaagcctacgtctattttcttgagacggtggttgatgatacagtctacggcaggtttgtattcggtactgagtccccagtatttggcaaagtcatttcctataccgttcggaatcatgccaagggcgatgttctccttgtcttcggcatcagagagcatgataccgttgatggcatcgttcagcgcaccgtcgccacctacgatgacaatggtacgatagccgttgttcgccagaattttggcaagacgttctacagaaccgaaaccttcggattgtacatagtcatagttgacacctttgctgtccatgtactccttgatttctttccatcgtttctgtacctttcgggtacctgctttggggttgtagatcactccccattttccaggttctacactcataaccgtatttctatcctaactgtattaacaatcgcattttttatctttcacagaccattcgtaaatgactggcaaagatactaattccctcgcagtttttctatcacaaaggctatcttttcttccataggcagctctgcactgacccagtggatggtaaatccccgacgttccatgccgcggaaccaagtcatctgacgtttggcgaactgatggatggccgtctccagctcagtgaacatctcttcgtaagtcagtttgcctatgacgtataacgtcaggaatttgtattccagtccgtaataaatcaagtcgtccggtgaaatgccttgttctgttaatcgccttacttcatccaccattccttcgtccagccgttgtttcaaccgtcgggtgatcttctcgcgacgcagttcccgatcgatatctaccccgatgatgaggctgttcaacttcggaaactcccgttcgggaaccggatgcacggcataatactcctcaatttctatcgcacggattgcacgtttcacggtatctacatccgtagagttgtgcaatgttttatattgcttcaggatttcggtcagttcttcgagagagtgattagccagacgggcacgtaactccggattttccggtaccggcatcagcttatagcctttcagtaccgattccagatacatacctgtccctccacataaaacgggcagacagcctttttgtttgatggattcgtaagaaatcaggaaatcccgctgatattcgaaaacattgtatttatatccgggatcggcgatatcaatcaagtgataaggaattggatgtccgtcgactgtataatctgccaagtccttgcccgtaccgaggtccattccccgatagatctgacgagagtcggcactgataatttctgtattcagttcatgggctaatgctgcagcaaaaggagttttccctgaggctgttggccctaatatggtgattaaatcatagtccggcatagctttattctttaatgacggcaaaaatacaaaataattttgacccagtgggttatttggatgcttttatctgattatttaataggaagcagaactcaaatttgaactacataaaagtttgaagaagcgttgagaaaagctacttattaatggtctgtaggatacgacatacctttccattcttgtccacgccctcgataatgatatcttcgggagctgtgctgtccggtgtatagtattctatggtcgctttgccttcggcgtctaaccgtaattccggattccagtaaacggtactccggaagtccgaacgctgagcgttctttttctcgggagtatcataggtggggtgatagaattctacggactcactgtatcccagcggcgtataagtgataattccctgcgctggtctggccggaagatttctagggtctttcagagtgatgacaacggcacctccggaagcacggggacccagtatgacggcatctgctcctcgaagcagactgatactggacatgtcactgacttggatatccttcaaaatatcggaagcatcttcatacacaatatcatcgataacaatgattgccggttcggaattgttacggatatgtatctcacttccgttcgtgattgtaacgctgggtagtctgctggctgcatcaaaagctgtctgaccgtatccttgcagtctgtcttcttctacagtataggtgttgatacctcccgtatagatactttttgaactcggacgttcccgcttcgctgtaactgtcacttctttcagattgtacacacgcattcccccttccatataatactggtcacgggtattcatcagataatcttccataaaggtagttgctccgttaaaataaggggctttatgcgtagcgaccgggtactggggaggatccattagaatatctacaccggcaaatcctttcttggtgcgtgcctgaacaaggaatgtcgtgctgtctctgaatgaggtattgacgatgaactggcctttctcgtctgtctcggtggtggctatgatattgtatttgggagccagtacacagatgggacctttctttacgtttgctccgaagaatcccatgattcgtccgctgatggtttgtcctttttctatataatttgtgaaattcagcgaaggagtgcggagaacattttccattttatgcctgcgccaaccatgtgtcatcatcagatagtcgatggaacggagcgtccgggcgtcctgatttagaaaatagtatgcggggtcttccacatatcctttcagatccgaagtcagcaggagattggacaggatattgtcggcaagagagtcgggttgaatacttttccggtcggtgatgctgacagagaaggttccttctaccgggttaccttcgttgtctttggcagcgatctgcaaagataccttctctctttttccatacgtcggttggtctgcagtgatttgccattgattcggcttatgatccggaacgaaaatcaaccgttcgctaagtgcatttccttgttcatcaatcagcatgaagtgagtgatcccttccgtaaacaggctgtcattcatctttccgaaagttcttttcggattgatgggttgtaaaatggccagtttgccacgggtatgtgcaagcaggaatagtttctgaggccattcggtcgcttctgtcttttggatttcgtagcgaatctcctgtttatagtgcgacatggcgatggagattcctttcggttctatggcaggaaggtcaaatcgcttggtaatactgtcattggttcttaccgtaacataataagtctcattgttgacgggattcattgtaaagatacccataccgttgtgttccgaccggaaattggtaagcgtgtctcctttggagttgaacaagaaaccttcgacttctttagaaaaaccgtctgctccctgtgctttgaaagcgacattctgatggggaatgctgagtagggcaccgtcttcggggaaaaacttcacatcgaaatcattggtgaacaccggcagatggaaagtccgtttgtagatatattgcggatcgtcaaattctacttctattctgcgcgctgccggagattttaaatcgggcagggaaatggaaatccagccgttttcgtccgtcttttttttgcctttgttttttatcttaccattctcaaggtataggtatttgatcgttgtattttcgaaaacagcctgtacgttgcttgtaaatttgattttggcagtgtaatgtgtatcgtcttcttgctgatactcaatgctcgaaacgatggtattgtcgatagagtttcctatcttgatgttgcgcgaaaagaaaaagtcggggtcttcattcagcatccagttgctgtacccccgcaggtagtaatcgcctgccggaagggtggcagggagggtgaaggcgttgtggaatccgagagaatctctgcggattttctttcgttccacaatggagtcggaacggttgatcagttccgtaatgataaaattactttgtgagttgtcctgatgggtggtggcgttcaccagatagcctttgaaccatatcttttctccggctccgtagaaaggcttgtccagatggaggtacaacttttctttaggaattctttccatcagactgaagttagctataatcgtatcttgcatggtctgtgcagatagcgatgagaaatatagaaggactcccaagagtactgtaatacttcttttactttgaagagtagtggtgtttttcatatattgtgtttttaatttttatgcatccagatagaaagaacttttcgcttcacagccagtatattaatgactgatacgatgaggaataaaagaatacccatactgacagctgcccataacgaaccggtttccagttgcgggaagaggagtctgatactctctatgtaatagctgcgcagccagcataccaatccgacagataaaatcagtacgatgatgttcagtcctacggtcagtatctgataaggcagcgccactctgttggggctgtagcctatcagaagcaggctttcgagcttggttgtattcttttggagcagtaagaatatgctgagcatcaggatatagaatgacaggatactgatgaataaacctactcccagcacaatacctacgataaggcgaaggaaataagtagtctttccggcatccagtttcccgtcttccgtctcgtagcctttcttttgaaagtagctggcaatcgaagagtcggcgggattgctgacctcgatgatcagtcgggcaggttgtgcctccgcgtcaggggcgaagttcttgttggcccagttcatgaaagactgcggaacgagaatcgtattcagacggttggaaaaaccgacgatgtttcccttgtattgttctacccgtccgttgccccgcatcatgatgtccatctgaataagtcccatcagtccttctgacaacttaggcagactgcggctttgagcgaaaccgaagttatacagattcagataattgcgtgggatgatgatgggaatggtatgtgtttcttcgtcgaagtgccatttatcgagtttgatatctacaaattcatcgggaactgactcgaagaacatatccgtagagagatgaatacccgcttcctgcattcccaatcctgccgaaactttgaattgagaaggggtgaaagctcctatcgttttggtaaacgactgttttttcagatcggcgatgtcatcgggagagaacgtattgctttttccggcaaaagacccgagcgtactgattttcttggttgctatgatgaagtcttttttcataaagctgtctccttcggtgaatacgggaatgacatctttgtaaaactgtacgctgagcaatacaatcatcatgccgaacaagttggctaaaaagaaaccggctaactgaccgatactgatatgttggcggagaagtttccagacaagggtattcattattttgtatttttatatttttaggcgcgaatgacgcagattctattatagttgaagcaccttcttgtatggcagttcgatatgtttgccaatggacgtggcgatgactccggcaccttgttttccggcttcgtcaatgatgatttctcccatgatgcggctgttctcatcatccaaatggctgataggctcatccagaaacaggaagtcgaacggctggcagaatgcacggataaaagcgacccgttgttgttggccgaaagaaagttttccggctttcacgttcagtttatctgagatacccagcttctcgaataatgaaagaatctcttttttcttcttgtgtccggtaaggttattcttcagttgtacgttttctatcgctgtaagttcggtgaagatacgcaagtcttgaaaaagcatactcagtgaatgctttctcaggtctacccattgcttcacggaatatgctttgatattggtttcatcgaaattgataattccttgataatcgttgcgatagccgtaaagatagctgcacaacgatgattttccggtgcctgaggcggcttctatcagatacatttctcctttccggaagataaggtcctgatgccatacatcagaggtcaccgaattacggtcagcaaacacttggggaagtgtttgctgtaagtgaatactattcatgccgttcattgacgaattacatgccggcgaattgcttggcaaaatctacgatttgtttgagggcattgacatctttgtctttcaggcaaaggtctgtttcgcttgtttctccttccgaactaacggataaataagaaactttggaagcgagatcagaataagtcttgaactccttgcctccgaagcctaccagcatctttacgaccggtaaatccagtatggcttctgcattgatggccataaatacggtcttgcctttcatgtctgctgcgtaaggagcgtctttgatcgatttgtcaaccgttttgccaatgctcttgtagagcagttcgtcattggtagcatacatctgtttgtccttgatgccgaaaaatatattcatgcctcttgttttgtagacatactcgtctttgcccagttccatgatgtcttctccttttctcatgcccagtgactgcttgttcttgtaaagagcttcaagagcattcccattctttacatcagcataagcaagaaaagtaggggcactgttcatggttacattgatcagcccggcagagatatcgccgttgaatgaactgaacagttcttttacttcatccgctttggcgatagacacagtgctgcggaattctttattctcactcaacagattgtaaagtccgtctccttttacgcccatattgatgaacatcagcgtagatgccggaaagtatttcacgaatgtgccgtttgtctttccaaatgattccatttgttttttcagaagcgctttgacggcgtcgttctccgtgtagttttctgttttaagggcgatcttgcctttttcgaagttcagtccgcctaggatggtaatgtcttccggtttgatttcagaaggaagtcccatgctgatctggcttctgtaagtagaagggattgctgacatggaggcgaagaagttgatatcactcttttgcttggctattttctggaaggctccggatttcgcaatgctgttgtcggcagtctgtttcattagtttggtgatggcttctttggctgcttctgtctgagaagttctgctggcagagataatgattgcagtggtttcattgaaagcaagcaagtttccgttcagggtagtgaagctatatccgtccgcttcgctgaccggctggcagatttgttcttttgccatcacatcgagggaagcgtgcaaatcgtcttcattgctgactttggcaacgaatgcaccaccggaaatttggggagagctaaagatatagatcggtgcttccggatccagaccggatgctcccggattgttgatcaccttctccaactgttggaaagtggcagcattcatcccgcttttcattgcttccagcagtttctgtttagcagcttcattttctttgtcgttcattccggctttgttggccagtgatttcaaatcaatagaggcaacagccgtagcgtctgccggtattacgttcgtatattccgtttgtttggaacatgctgccagaaacacaatcagtactgccagtaccgagagccgtgagatcattttctttgccatactcatactatttaaaagttattattggttcaataagttcattgtgtggcaagccacgagtgccgctgtctctgtccgaagccgtgatttacccaagctgatgggagtgaatccgcattcgatggctttcttcacttcctcttcgctgaagtctccttcgggaccgatcagaacgagagcatcttctcctgctttcagtacatttttcagctgaggcttttcgccttcgtaacagtgagcaataaatttctgaccttgaaactcttgtgcaatgaacttgtcgaagtccgtcatttcgttgagtttcggcaggcgagccttaagagattgcttgatggctgatatcagaatcttttcgatccgttcggttttaatcaccttgcgttcggaaaaacggcagttgagaaaagtcagttcgtcaaatccgatttccgtagctttctcggcaagccattcattgcggtccatatttttggtcggcgccatggcaatgtgcagatgacacggccagagcggttcctgaaagattgtttctttgatggctacaaggcaacgcttgttggttgcaaccgtgatttctgctttatagaaatgtcccttaccgtccgtaagagtgatttcgtctccgatacccaaccgcaggacgcgggtacaatgttgtgcttcctcttccggaagttcgtagtttttctgtatatcgggagtataaaatacgtgcataattggttagtggttttgatttcttgaattgatccggtcgcgtatcttggcagccagttcgtaattctcgtctttgattgcttgatccaatgcttcttcgagtgacattgaagtaacgttgcgaggcagatcccgcttcttttcgtcttccgcttcttcatcagactcttcaggatgtcttctttcctcgttcgatatccgaaggcattcctgttccagaatggattcataaatgaggatcggacattcagcacggattgccataccgacagcatccgaggtacgtgtatcgatacgtataatttcttcgtcttttttaaggtaaatgtaggaatagaaaataccgtccttcgccttgtagatcaatacgcggagcaaactagctcctaatacgccgataatggtcatgaacaggtcgtgtgtcagagggcggggagttttgacccccttcatatacagggcggttgcctgagcttcagcgggacctatgatgataggcagttgccgttcaccgttcacttcacccaacagtagggcaaaagcgcctacttgcgcttggctatttgtgatatttaaaacttgtaattctacttttttgtccattgttcttttttacttaatttactttattctctcgttggtgtttgtacttgaataccagagcaaacaggatgccgatcaccagtgcatacgccgcaaagataaaccagatgtccggccattcacggctcactagtttgccatcagcatatactgagaatgcgtctacgacagcaccgctggcatatcctccgatgatggcacccaacccgttggtcatcataaagaacaacccctgggcactggcacggatggaggaactggtttcttgttcaacaaacaacgaacctgaaatgttgaagaagtcgaacgccataccatacacgatcatggaaagaatcagcatccacagaccggaacccggatctccgaagccaaacagcccgaaccggaatacccaggcgaacatactgatcagcatcacttgcttgatgccgaaatgtctcaggaagaatggtatagcgagaataaataatgtttcagacatttgagaaatagacagcaggatcaccgaatgttttactccgaaagaatctgcaaactccggaatactggcgaagctcccgaggaaaaggtcaccatacgtgttggtgatctgcaatgctgctcctaaaagcatggagaacaggaagaaaatagccattttctttcttttgaataatacgaatgcatccagtccgaaggaagaaagtaatgttttcttttctgtcttggccggtttgcatgccggcagggtgaaagagtataaacccagcaagagtgcggatgcaccgcctacataaagttgtgcgctggaattcttgaatccggtaaggtctactgcccacatggcgcagataaaaccaatcgttccccatacacggataggagggaagtccttgatcaggtcgcatttatattgttccagtgcattgtatgaaacggtattggccagtgacagggtaggcatatataccaataaattgagtagcatagcccaatacatctggtcataattcgtaacggtagaggcatagaaaagacaagctgcccctgcgatgtggcaaagtccgtataaacgttcggcattgaaccatttatcggcgataataccaatgatgccgggcatgactaaagaggcaatacccatggtggcgaagatggcaccgatctgtcctccttcgaagtggagttctctgcccatgtaaccccctagtgaaattaaccatgacccccatacaaagaattgcaggaagttcataatgatcaaacgaacttttatactcatgacttttctaatttgtgtttctctttttacgttaataatagatgcaaatataatattttcgttgattgggtggacaagttaatcgataaaaaggggataaaaaagccataaatgcgaagaatagtgaagaattactgttaaaaagagggtggataggcatataaaaaaagaaggctatctatcccagacagccaatctttattaaccttaaatctaataccatgaaaaacacagtgcaaatataaagggttttatgttatagaacataatgatttgccgaaaaacttctatttgttaactctaattaactttgaaactattatttttcttttattcaccccttgtttatgcaagttcatggtgtttatgacatatattactctacatagagtaccagccctttcaggtattctccttcgggatggtatatatttaccgggtggtcggcaggctgggttagttggtgcaggatacgtacactacgtcctgacatagcagcagcggtaaacacagctgtgcggaaattatccttggttaccacctgagagcaggagaaagtaaacaggatgccgcccggtttgatcttttcgaatgctttggcattcagtttccggtaaccttgcaaggcattccgcaaagcatccttatgcttggcaaatgcaggcgggtcgaggattatcaaatcgtattggtcgcccatgcggtcaaggtatttgaaagcatcttcggcgaaagcttcgtgacgcgcatcgccggggaaattcagttctacgtttttgttagtcagatcgattgctttggcagaactgtcaacggaatgtaccagctttgcacctccacgcatagcgtagaaggagaaaccgccggtgtagcagaacatattcagtaccgaacggtctttagaataatgctccagcagtgaacggttttcgcgttggtctacgaagaatcctgtcttttggcctttcagccagtctacatggaacttcaggccgtattcccgtgcgatattatcgctgcttcctcctttaaggaaaccgttttcgggaaaaagatctgccttaaaaggcagtgtagtctccgatttataatagatattttcgatcttgtcacccattacttccgacagggcttcggcgatagtcatgcggtctacatgcattcctgcggagtgcgcctgcatgacggcagtccgggcataaatgtcaatgaccagcccaggcagattgtctccctcaccgtgtacaagacggtaggtgtcattggtgggattgactgcgataccgattccacaacgcatatcataggcaatttgcagtttacgtttccagaaatcgtggtcgatgggttcctgacggaaagagagcacacgtacggcgatacttccgatctggaaatgtccttcggctataaattccttcttcgaagtgtatacttctacaacttcaccttcttcgggttctccatcgaaacgagcgattgctccggagaaaatccagggatgaaatctttttaaagactcttctttgccgggtttgaggtatactttatgcatgttgtttaaaatgctattttatcagttattaattagtcttttatcggtcatttgtcagcgattggcgggagcatttgcgtcaacctcttcttctacagggaggctttcgacctcgtagttgccggttcgtttcagttcctgcaacaggttgtagatgttgaggcaagcccaggcatcggtagcggcatattgtttctgtccgtcgctcagtacgtccgcttcccagttggacagccgttgtgatttggaaatcttttctttgaacaggattgcataaatcttttgcagacttttgtcctgtatgccgaactggcgtacatagtcttgcagttcgatgcagctctgttgggtaaaaggtgcacgtttgtgcagcatcataaagtcgtctttgagcgacagtcctactttgataacagccggattttccagcaggtcgaccaaaggttgggtgagtccggtcatattgaggcggaacaggaaacagcattcgtctgaagaaatctgcagaagtgctactttatgactttgtcctttggtgaaggatgggcgcgtttcgctatcgatacccagtatcggctgagattgcaggtaagctactgctttttctgtttccgcttccgactggatcacatggattcgtcccggaaatacagttttcgggagttcctttagttcgtctttatttatacttcttcttactatcatttttgtttattcgtcattacgacaatggcaaccgtcctcatgacaatgacattcgtcgtcgtggcagtgacaaccgtcttcttcacaacaatagtcgtcatcgcttagttcgttattctcttcctcgttgtcttcttcgtcattctcattctgctggttatacttcacatcgtgaagggcacgcagagtgtttaccaacttctgtccccacagcagaccgaagttttcctggcagatggccaacgagtcgttcatggtttcgttcagtcccagctggaagacgaaaataaaatctttgatatcctgatagatatccgccaaatcttccgagacggactttttgataggctggtcactgtacaccatatcctgtacgaaaacgtccagataatcatccttttcacccatcagccctgctagattgatacgcagaatctcgtaaatttcctccgtcacatacgtttcgggtgcctcgtctccgattgtttcacacttcggaagcaaggatgctttgagatagagcaggggaagtatttttaaggacgtgtcgacaaaagctttgcgcttcatgtgttcggcacgttcgaggaatgcgcaaaattcggcggctaccgttacgaactcgatcacattcttttcaaatatcgtttggctttctttttccataatcagattgatttgaatcgcaaaggtaagaaaaaggattgaatgagagtactgctcgttatttttttattatttttgcggcttataatacggattccaatttatttaaagaataaagactcatggcaaaaaagaaaatagataaggaggctgaacgcactccgtcttctcccggaaagattgtatcaatttttaagaatgaaaccgttcattttgtgctcggattgatgctggtgatcttttccgtttatcttttgttggctttttcttccttcttctttacgggggcggccgaccaaagtattatcgacagcggcagctcggcagaccttgcggcggttaataataatgtaaaaaactatgccggatctcgcggagcacagttagctagctatctgataaatgactgcttcgggatatcttctttctttatcctcgtctttctggcggtggcaggattgaaactgatgcgggtgcgcattgtccgtctgtggaaatggtttatcggttgtacattattattggtgtggttctccgtattcttcggcttcgctttgatggatcattatcaggattctttcatttatctgggaggtatgcacggttacaatgtaagccgctggctggtttcgcaggtgggagttcccggagtatggatgatcctgctgataacggctgtctgcttctttatatatataagtgcacggacagtaatctggttgcgcaaactttttgctctgagtttcctcaaacgtcagaagaaagaagaagaaaaggagactgcggcagaaggaacacaggagttcacgacctcgcaaccgcaggaagtggagttcaatctgaaacgtacttataagcaaacacctcctcctgctcccgtgatggatatacaggcagaagagccgaaagaagaatctccggtcaacgcaccggaaccggacgacgaacttccttctgctgatgaggcggaaggggtgactatggtctttgaaccgaccgtaagcgatgtggttcctccaattgctcaggatgaattgccgggtgaggatgaacccggatttcaggtagagacagctgcgtcggaagaagaatatcagggtccggagcaagaaccttataatccgatgaaggatctggaaaattaccgtttcccgacaatcgacttgatgaagcattttgagaatgacgatccgacgatcgacatggacgagcagaatgcgaataaagaccgtatcattaatacattgcgcagctttggcattgaaatcagtacgatcaaagctacggtaggtcctacggtgactctttatgaaatcactcctgaacagggtgtgcgtatctcgaagattcgtggcttggaggatgatatcgccctgagcttgtcggcggatggtattcgtatcattgctccgataccgggtaagggaaccatcggtatcgaagttccgaacaagaatccgaagattgtatccggtcagagcgtgattggaagcaagaagttccaggaatccagatttgacttgccgattgtactgggtaagacgatcacgaacgaagtgttcatgttcgacctttgcaagatgccgcacgtgttggtggcaggtgctaccggtcagggtaagtctgtcggcttgaatgcaatcattacctccttattatataagaaacatccggctgaactgaaatttgtgctggtcgacccgaagaaggtggagttcagcatttactccgtcattgaaaaccattttctggccaaacttcctgatggaggcgaaccgattattacggacgtgaccaaggtagtgcaaacgctgaattctgtttgtgtggaaatggatacacgctatgacctcttgaagatggctcatgtacgtaatgtcaaggagtataatgagaagtttatcaaccgccgcctcaatccggagaaaggacataagtttatgccgtatatcgtggtggtgatcgacgagttcggagatttgatcatgactgccggtaaggaagtggaacttccgattgcccgtattgcgcagttggcacgtgcggtcggtattcatatgatcatcgctacgcagcgtccgacaacgaatatcattacaggtacgatcaaggcgaacttccccgcacgtattgcgttccgtgtatccgccatgatggattcccgtacgattcttgaccgtccgggggcaaaccgcctgattggtaagggagatatgctcttcctgcaaggtgctgatccggtacgtgtgcagtgtgcctttatcgatacgccggaagtggaggagatcacgaaatttattgctcgtcagcagagttatcctactccgttcttcctgcccgagtatgtgagcgaagacagcggcagtgaagtgggcgacattgatatgggacgtctcgatccgttgtttgaggatgcggcacgcttggtggtcatccatcagcaaggttccacttcgttaattcaacgtaaatttgctatcggttacaatcgtgccggacgtatcatggaccagcttgaaaaggcgggaatcgtcggacctacacagggaagcaaggctcgtgacgtactctgtgtcgacgataatgatcttgaaatgcgtttgaacaatttacaataacagatcgtttattaatcaaatgaagaaatacatttttagtgttttaatagctttactgtcactgcctgtgattgctcaacaacagcagtcgcaggctaaagctgttctggagaagacggccgaagcgtttaagaaggcaggtggtgtgagggccgattttaccttgaaggctgtcaatgacggtcgtttggaagggcgggagaacggtatcattcagttgaagggcgagaagtttatgctgaagacttccgagaccaccacttggtttgacgggaaaacacagtggagctacatggtgagaaatgatgaagtgaatgtcagcaatcccactcaggaagagttgcagcagatcaatccgtatacctttctttatatgtatcagaaaggattctcttataagctgggaactgtgaagacatatcagggtaaagctgtttgggaagtgattctgactgccaatgataaaaagcaagagttggaaagcattacgctttatgtgacgaagagtacgtatgaaccggtttacattcagcttcagcaacgtggtcagcaaacgcgtaatgagattaccgtgacagcttatcagaccggactggattatgcggatcatgttttcactttcgaccggaaggcataccccactgcggaagtgatagacttacgatagaatattcttttgagtaagagacgagatagttggaatataaaacaataatataacaataaaatggcagaaatagaaaaagtaaaatgcctgattataggctcagggcctgccggatatacggcagcgatctatgcaggacgtgctaacctttgtccggtgctttatgaaggattgcagcccggtggtcagttgacgactaccacggatgtggagaacttccccggttatccggaaggaatcagtggtccgcagttgatggaagatttacgcgcgcaagccagccgtttcggaacggacgtccgtttcggtattgcgacagcggcagatttgagcaaagctccttatcaaataacgattgacggcgataaggtgattgaaacggaagcattgatcatctctaccggagctacggccaaatacctggggctggaagacgaaaagaaatacgccggaatgggagtcagcgcttgtgctacttgtgacggtttcttctaccggaagaaggtcgttgcagtggtgggcggtggagatacagcctgtgaggaagcgatctatctggctggtctggcatccaaagtatatctggtggttcgcaaaccttacctgcgtgcatcgaagattatgcaggaacgtgtgcagaagcacgagaagattgaagtacttttcgaacacaatgtagtcggcctgtttggcgataacggcgtagaaggtatgaatgttgtgaagcgttggggcgaatcggacgaagaacgttacagcctgcctatcgacggtttcttcctggctatcggtcacaaaccgaattcggatattttcaaagagtatatcgacactgacgaagtgggttacattattacagatggtgacagcccccgtacgaaagttcccggagtattcgcagcgggagatgtggctgatccgcattaccgtcaggctattacagcagcgggaagtggctgtaaggctgctatcgaggcggaacgttatctttctgcaaagggaattatttaaagatgaagcaaggcggaatgctttgcatggaataaataagaactgaatcaataaaaaaaacggtggacatgagcaacaagctgcatgtccaccgttttttgttatgtcacaggcattaatatgcctcgatttcgtctatccacaattcggcaggaatgacttccggaccgttgttctttttgaaattgacgccattacgcaaggtaccgccatttttgatttttactttcaggaaagtggcttgtgtcggttcaaattcgatagagtcggtgaatgcgattcttcccgtttccggacaatcatgcttcaaggccttttcggctatctgagtatattgctgaccgtcggcagatacttctacggcaactcctccggcagggagcattctcatggcaggattaaacaaggagccgaagaccacttttcttacttccgtcggtttgtccagatggacgatgaattccaggtctttaccttctacgattgcgaaactggaccacggagtgtaagaagcattgttacctctctttccatttgtcagaccgaaagttgttttgtcagctcccaatacatcattgtcgccgaaaatatcccctgtccatcccattgtataattgacggtaaatggttttcctgccagcagattgccatacaatggcttgttggtaactttgcccagcatcttgccgtctttgaaagcagcagctttcaagtcgatgtttccttcaagcacgaaaggctgttcatacagtgtagaaccgtaagtcggttcgctgccgtctgtggtgtatctgatttccgcattcgggtagaatgtttccagcaataccatcaacggaccgttttcatccgcatgcgtattgatgtttacgtcgaagaagttgaggcagggtttggtatccatgacttccaggcgctcaaattccgtaaccatgcgttcgcagaaactcttccagtttttgttggcatccagtgtccatcccgtttccgcgatagccatcgcacgtgggaaggcctgataatctacccggtcggaagttttcatatactctctccagaggttgccttgcataccgatgatatgtttcttcaccagttcgtcggcattatccggaacaggattgtagctataagtcttcttcagcgttgtgtatccgccgatggtagtcggggcgatttccggatcttcctgatagaagtccagataagcataaggcatgggagccatgattgcgttgtgtcctgctttggccgcattcaatccgccttcaacgccacgccatgacaagacagtggcgtttggagccaggccgccttccaaaatctcgtcccagccgatgatattgcgtcctttaccgttcaggtatttttccatgcgggtaacgaagtaactttgcagtttatcttccttgctgtgcttcactccgtccactttgctgggagtcgcgtcatctttcaagcctaactgacgaatcaactgctggcagaaagtactgttcttccaggctgttttggggcattcgtctcctccgatatgaatgtactcgctgggaaataattcgactacctcgtccatgactccttcaaagaacttgaaagtggtctcgctcgggcagaatacctgttcgaatacgccccacgtaggtgatactttatatgtctgtgtagaatcacaagacaattcggggtaagcagccagagccgccaatgcatgccccggcatttctatttcggggattacattgatatatttgcttgcagcataagctaccacctcttttatctgttcctgtgtgtaatatcctccgtgttctattccgtcgaatacttgcggatagttcacataataatagtctaccagcgttttttcgcgtttggaacctatctctgtcagtttcggatatttcttgatttcgattctccatccctgatcgtccgtcagatgccagtgaaaaacgttcatcttgttcattgccagcaggtcgataaatttgtagatatactctatcggtgcgtaatgacggcaaacgtccaacatcagtccgcgatgtacaaagcggggagcgtcttcgatctctacagccggaacagaccagtcggctttcttcttcagctcttttccgtatacggcgggaggaagaagctgataaatagtctgcacaccatagaaaaatccatttggctgggaagctgtgactgtaataagggtgggggtgacagacagcttgtaaccttctttaggcataccttcttgtagtacgaaactgatagcaggctttccatccacgctttcggcctctgtcagagagattccggcagtctgtttcagctgttcggcaaagccgtcggctacctttttaacttccggagcatcagacggaactaccagccggaccttgttgctcagttcgaagcggccttctttgggaacaagctggttgggttgcggaacgatgttgtactcgttcgtcacttcttttggcttctgacaactgggggtaatcatgagcaaggacaaaagaagaagggaaatacttttcttcatggtctgaaattgtgttaagttattaatatattgacaggacaaatgtacttgtttaattggtaagttccaacagtatagaaataaaaaagccgatgtgacgaacatcggcttccagttaaagtttcagatcactttttatgatcgtataaggtctgtattatcctatcttgcttattttcttgagtttttcttcttcgatgatcttgatctttcttccgtcaatggtgatcagacgttccgtagcgaactgtgataaggtacggatggcgttcgaggtggtcatgttcgacagatttgccaggtcttcacgggaaagataaatactcaatgtcgatccgtcttcttccagtccatagctctctttgaggaaaatcagcgattctgccagacgtccacggatatgtttctgtgtcaggctgacggtacgttcgtcggaaatgccgagatcgatagaaagctggcggataaaaaacatggctaaatcgttgttttgagcgaccagcgtggtgatggcagtcatggggatgagacagataacagaaggttcgaaagcggcggcggcagttacgaagtcttcctttgcgaagtatgcacggtacgcaaagtattcccgctgtttaatcatgcggataatctgacttctacctcctacaccatctttgaagattttgactttgccggtaatgaggcacatcaaatgagagggagtctccccttcgcagtagatggtttcgttctttttgtaggtctgtatcgtataattgttcatcagaaactccctttgttcgttattcaaaggagctaacaaatcggataatggttccgaaatatcgatgtctgacatgttcatttttaccatgggtgctacaaaactgtgttatacagcacaaaagtagaaagaaaaaatgagaaaatgaacgaatctataaaaagattgcacaaaagtaggttctttcgtgcaatcttcaggagttttttatttggtgaacaagagttccctatacttgggcagcggccatatttcgtcgtctacctccatctccagatggtcgatatgatcgcggattttatcgaggtaaggacgcactttttcttcgtattcgaatgccctctctttgtagttatctttgtgattggctacttttcgggcttcggtcatttcgcgtaccagtactttgatggaagtcacccggtgcgagatttcacgaatcagttctttgcggtcagcgctcaatacttcgtattcttccggagagaagatttctttcattttgcacagattctctagcagccggttctggtaggtgacagccgtcggcacgatgtggttgatggcgaggtcgcccaatacacgcccctcgatctgtaccttcatggtgtatttttccagttctacttcgagacggctgttcagttcggtttcgttgaagatgcgttcgccgatcagtaccgatttcgactggttgtctacgtagtgcatcagcgcttccggcacgtggcagatgttggtcagtccgcggcgggcagcttcctgtctccattcttcggagtaaccgtcgccttcaaagcggatggcttcggaagcgatgatggtttctttcagcaggcggaagatagcttcgtctttgcccactccttcttccatcagtttctccactgatgcgcggaattcgttcaactggttggccatggcggcgttgatggcgatcatggcggcggcacagttggaagaagagccggcggcacggaactcaaagcggtttccggtgaaggcaaaaggagaagtacggttgcggtcggtagtatcgagcaggatttccgggatacgtccgattcccagtttcagcgtagtcttttcttccggtgtcattttctcatttcctacctggcgtacgatttcgtcgagggttgccgagagttgtgaaccgaggaagcaggagaggatggcgggaggagcttcgttcgctcccagacggtagctgttgctggcactcatgatggaggcacgcagcaggtcctggttcttgtataccatcatcagtacgtttaccaggaaagtaaggaacagcatattgcctttcgggttctttccgggggcaaacaggttgatgccggtgtcggtgcagagcgaccagttattatgtttgccggagccgttaacgctgctatatggtttttcgtgcagcaatacattgaagtgatgcttgcgtgcgatacgcttcatcaagtccatgacaagctggttgtggtcgtttgccaggttgcagttttcgaagatgggagccagctcgaactggttgggagctacttcgttgtgacgggtcttggcagggatgcccagtttgtgacattcgatttcgagttccttcataaatgcggtgacacgtggaggaatggagccgaaatagtggtcttccaactgttggtctttggcggaagagtgtcccatcaaggtacgtccggtcagacaaaggtcgggacgtgcattatataaggaggagtctacgaggaaatattcctgttcccatcctaagttggtaaagacgcgtgttacgttcttgtcgaatagctggcaaacctccgtagcagctttgtctacagcagcaagtgctttcagaagcggagtcttgtaatccagcgcttcgcctgtgtaagagataaagatcgtagggatacagagcgtggtatctactacgaatgccggagaagaaacgtcccatgcggtatatccgcgagcttcgaatgtattacggataccgccattggggaaagaagaagcgtccggttcttgctgaatcagcagttttccggagaatcgttcaatgactccgccgtcttcgccgaattcgataaagccgtcatgcttttcggcggttccgtctgtcagaggctgaaaccagtgtgtgtagtgggtgacgttgagcgacttggcccagctcttcatgccgttggcaatcaggtcggctatttcacggctgatcggtgtacctttttcgattgcatcggtaacagccttataggcttccttcggaagatactcctgcatcttcttgcggtcgaatacgtggctaccataataatcagagagtttgttggaaggggcagtaacttccagcggcttccggttggaaagttcttgtaatgcgtaaaatctcatttttgacataaatcgtcttctttttatcggttgatggcgcaaaaatatatgttttttctgaaagtacccctattttaaagggggtattttcggaaaatgatatatttttctgaagaataccccctccttataggattgattcgtctctgaatcaccttttgtccatcacggcactttttgattataaccgattaagagatggattccagtatttcctgctgtccgtccttgtttttctgtcggtcgatttctgcagccatctgtttgactagtatttctacctgcatataatgcttgtttatgtttctgtatagcagcttcattgtagtactgtccatagccatttgggtgaggaactgtaaatgttttcccatcgaggcgttcatttgcatatgcgtttttttatcctatactaaatttagtcccggcttgtgcaataaataatactttggagtgcataaattaattcgtccgcctatagccggatgcaagtttgcctatagtcgacgttgcgtttgcctataggcggacgaaacgttgcctatagccggacgaattaattcatgcactcgaagatattattttttatagagaaaatgtttattgtattctactgtaatgattgaagaaattgggaagtggatttaataagtagaaaaatgtccatgaaaactgatatgatgcgtggcattgagaaaggattttccttgctaacgcttttttgcagcttaattcccttgcttttcgatattcttttttatatttgcctacaataaacaaggagatacgacgattgaaatataagatattgataggatgtatgttgtgcttgttctcttttattccgaagggggcagccaatcttgttcttaatccttatacaagtcaggagatatctgctgattccatcattgagcgtgtcatgacttttgctccctcttatgaaagtatagtgagcgactatcgcgcgaacctatatataaagggtaagatgaatattcagaagaagaattttatcctccggtacgttccttcgatgtttcgcttgcagaagggggtacgtgaatacttgctcgaaacgtatagtgacctgcattatacagctcccaatatctatgaccagaaagttaaggcatcacaaggcactgtgagaggaaacaggggactgccgggattacttgaatattttagtgtcaatatctactcatcttctcttctgaatgacgaacgcttgctgtctccgcttgccaagaacgggcagaaatactacaaataccggatagacagtgtgatgggcgatcccaataatctcgactaccggatacgtttcattccccgtaccaagagcgaccagttggtgggtggctatatgattgtcagcagcaatgtatggagcgtgcgtgaaatccgtttttcgggacggtcggaactgattacgtttacttgctggatcaagatgggggaagtaggaaagaaagatgaatttctcccgatacgttatgacgtggaggccctttttaagttcctgggcaataaggtggacggcaattataccgcctcgctggactataaatcgatagaactgaaagaaagaaaggttcggaagaaagagaagaaaaagtataatctgtcggaatcattctccttgcagtgcgatacgaatgcctataaaacagatgcgtccacgttcggcgtgctacgccccatccctttgagtgaaggagaaaagcaactttacaaagattatacatacaggcgggataccgtgtcggtgcaacagaaaaccaagagtcaggctttctggggaacgatgggcgacctgatggtggaagattataaattcaatctgtccaatatcggaagtgtccgcttctcgccgtttatcaatccgcttttgttcagttatagcggaagcaacggattatcataccgacaggatttccgttacaaccggattttcagaggcgacaagtggctccgcatcgtacccaaactgggttataactttacacggaaagagttctactggtcgctgaatgccgactttgagtactggccgcagaaacggggctttttccggttgagtgtgggtaatggtaaccgtatctatagcagcaagatgctggacgaactgaaagcgatgccggacagtatctttaatttcgacctcatccatctggattatttcaaggacttgtatttcaacttccgtcatagttttgaaattaccaacggactggatatcagcctcggtttctcggcacacaagagaacagctgtcgagaaatcccgttttgtgattacgggtgactatccgatgcctccgccggaatttatggaacgcttcagaaatacctatatcagctttgccccgcgcatccgggtggaatggactccagcgctttattattatatgaacggaaagcgtaagatcaatctccgctctgactatccgacattttcggtggactatgaacggggaatagaaggagtatttaaaagtactggagaatatgaacggatagaattcgaccttcaacataagattcagctggggctgatgcgaaatatttattatcgtttcggcttcggggcgtttaccaatcaggatgaactgtactttgtggactttgccaattttgcccgtcataatctgccggtagggtggaatgatgaaatcggtggtgtgtttcaggtgctcgacggacgttggtacaactcctcccgccgctatgtacgcggacatttcacttacgaggctcctttccttattctccggcatttgatgaaatatacccgctatgtgcagaacgaacgtctttatatcagtgcgctctctatgccgcatctccagccatatctggaagtgggttatggtatcggtacgcatgtctttgatgtgggagtattcgtcagcagtgagaactggaagttcagcgggatcggatgtaaatttactttcgagttgtttaaccgatagttttttcttcataacagttgcataatgtatagaaaatacatatctttgtgaggaagaggatgaggaaaaatttagcagaaaagaggtgtagtcgcctcgcaggcacaggtattttcctggaaaataaatctctggtataaatacctctatttattttagtaaaatctcatcctcttcttctcctttttatatatgtaacaacaagatggacggaattttaattacgatacttattgttaccggttttctgatttataaattgatttcttcgagccggaaacaggaaggatataagagatggaaagcaacaggcagcggtaatactactaacgaagagacttccaaaaacaaatgggaacatggagcctggctcaggcatgctttaggagtagtcactcctaaaatgagaacatgtcctgtatttgatgaagaggcggtggtgtggtgtgccaatctgttgggaatagaggtgatgaggttgaaagagatactgcaggatgtctcttcgcattatcgggagttctggatcagaaagcggagaggaggataccgtatgatctctgctccggacaaggaactgaaagccattcaggatactatttatcatcgtatattactgtctgtaaatgtgcatcctgccgctacgggattccggcgtcagcattccatcgtcgataacgtccgtcctcatctgggaaaacgctgtgtcttgaagacggatatccatgatttctttatttccatacgtagtccgagggtgaaaaagactttcgaaaagatcggctatccgaagaatatatcgaaagtgctgggcgagttgtgttgtatgcgtcggcatttgccgcaaggagcgtctaccagtccggtactgagtaacatcatcgcttatgagatggaccggaaactggcggtgatggcggaagaattcgggctgacttatagtcgttatgccgacgacctcaccttttcgggcgatgtctttccgaaagaggaggtgcttgcccgggtcaaggaaatcatcagggaagagaagtttgaaccgaatcatcagaaaactcgttttctgaatgagaatgacaggaagataatcacgggcgtatccgtcagctccggtgtgaagctgaccattcctaaagcccgaaagagagagattcgcaagaatgtctatttcattttgacaaaggggctggcggaacatcaacgcagaatcggctcccatgatcctgcttatctgaaacggttgatagggtcgctttgttattggcgttccatagaaccggataatacgtatgtagctgattctattgctgctctgaaacgtttgcagaaggggtattgacgggtggcggctgtttgtgtctgccttaccgtgttaatcgatgatcgttgcccttccgttttcaactttggcataattcctttttaccgcttcctgaatccctctgagcatggatgcttcgatgtttgaccccatgtgtgtgaagccgaatacttgtgcgcatgcttttgccaaatcgggtaaaggcaggctgatggaattgattaatatttgttggatggcattggctatttcttcgggtggcagatccgctgcatctcggtcggaatcgggacggtactctgaataagaacggtattgcgcttcatctttccagcagaagataagcccgtcatgttctatgcggtaaagatgtaatgtgtcgaatattatttccaattgagcatctattcgtggtcctacacggttgactccccattcggatatgattttctttccaagtaaggttttgctgatcggggcttcattttctattatcttttggacttgggagacaataataggattatttcttttagcgaagatgtcgtcggcagcgtacaggaacggacgtattttagtactattataattttgtacggagataaaggaaaagtttgtgtatgcgcatgcagattttagctgcatcggcgtttcctgcacattcttttctcttttttcttgttccttttttactataaccggtttctccgctttcatatcctgagcaatcgctgcttgtatagacgccatcacttcatccggcttttcccaccagtccatcgtccatatacggcagatattccatcccagtgctttgagtacattgttttgaacaatttcccggtcacggacagtcttggtacgtctgtagttctttccgtcacagataatacctaattggtagttggacggggtttgagtatcgacaatgccaatatcgatcttatatccggaacagcctatatcagtatgtacggtatatccccaagaacgtaacttgtcggcaataatcttttcgatagaagtttcttcttccgaggtccgaatattagtcgaggtattcagtatgcgcttggttcctttctccgcatattcaaggaagcgtttcagcccggctactccgatagaagaagttcggttcagatcaatcatgtccgatctcagcgtagaaaagatgatcatttcgtatcgggcacgggagacggctacgtttaaccgtctttcacctcccgcacggttcaacggaccgaagttcatgctgacgcgcccttcggcatcgggaccatagccgacggagaacagtatcacatcccgttcgtctccttgcacattttcaaggttcttgatgaacaggggttcttcacattccagcgcaaaggtttccagttcaggatgaaaggcgaagagatcggatagcaaatcttctatcaacgcctgctgaaccacgttgaaagtaactacccccatactttttctccttaatttttcgctcctcagccttctcgctatttcgtctactatggcttgcgcttccgcttggttctgacgggattttcctttgtcataataaccgtctacggcgaccattctgactttcgattcaatattgtccggtgacgggaaagtcatcagcttattatcgtaatattcggagttactgaaagtgataagactttcgtgtttgcttcggtaatgccacagcaggtatttggaagggatagagagagcgaggcaatcgtcaaggatactttccagatcttctatctcgatgttgtcttcgtcaatggtattaacggagaagaagctggtaggcggcatctgtttggggtcgcctacgataactacattcttgcctcgggcgatggcacctaccgcttcgtaagtcggcatctgtgaagcttcgtcgaagacgatcaagtcaaatttctctgcatcggcatcgatatattgggcaaccgatataggactcatcaacatacacggacacatacgggacagcaggataggtatttgatcgaatagcttgcggatggatattccgcgtgcattattgcgtatattcttttgtaatattccgacttctgaactttgaatggcttcgtgggtgaaggacggaatgttggaagccagtctggcgaacagttcctttttggtaatgtcctcgaagttggcggatacctgcttgtatttggttataatatcattgaatatcttgccgttgaataattccagcgtcggttctttggcgatgatatagtgaataacggcttggtagaaactcttgcggaagctgctggtgagtaaatccgtaggaatattcttttccttatattcttctgcgataaatccgagacccaactcgttcagtttgttgtaggattgaagccattgataccagtctttgagtttgtccagattttctttccatattccggcttgctgtagggcgatgccgatccagtcggcggagtttgtataaagcgtctctacggttatgcccagagtggtggaaagccgttgctcggttgccgtaagcgtgtcgaccagctgatacaattcattcagagaatgagaatggatatctctgaatgtccggataccttctgtcagttgtaacgctaagttctgtttgattcgggatgttttcgccacatcttttgaataactcagtaacagggaatgaagcgaagatacctcatggatgatctgatcgatgatgggccactcttcatctcttccgaatcttccgaataaagaaggcagcttggcggtgtatctgtctgtaaaatcaagctcttcctgataccggatgacctgatggagcaaaggctggactgtctctggctttaccggttgcagagcgtaaggacgaatcaccttttttatttttctttgtccgaaatatcgtgggagaaaccattgggcggatacccgattccattcggccagcatggggccggcgtttatcttcagtacctctttggtgaatccgttttctatttctgctttgatttcatcgcgtttcctgccgtgttccgtcactttccggtactcttccagcgtttcatttaataaaggagtggtcagcagttcgggcgtcagttccggaatatcgagtatttttcggataatggcgctgattatattgaaatccttgcgggtgggatgaatgtccgtattttccagtaaagcggaaaagacaggcagtttcgattgtatggcagtcaataagccaatgaaagtggcgagcgtttgtaaggcttcctctttgatggcggacgaatattcccgaatgaaaatccctgtcaatgggtgaagatacgggtggccgcaagcattggcggtactgaccaaagattcgatggcatcttcccaatgtgagaatcggtctttgtccagattgtccagataagatgacggaatatcgaagcagggttcaacgtctgttaactggtagtggatgatcgcatcatagagggaaagtccgaaaggatattccttgtgtaaggcttcgatgtatttgtttagttccgttcgtaacttcagcaggcgttcggcttccttcatgaactcttcgggaggagttcgtctgatgatttcggttgtctcctttagttgcgagatgacagtggatttctttgtcttgttggaatgaatctccagacagaacggggcaagccctatgcccgccagtctgttttggacgacggagagggctgccatcttctcggcaacaaataagactcgtttacctttataaagtgcgttggcgatgatattcgttatcgtttgggactttccggttcccggagggccgtgcaggataaaagtcttgtcgtgcaccgcttcataaatcgcttccagctgagatgaatcggcaatgataggcagtacaatatctgccggagataactgcctgtccatgtaggcggcatccacttctttcgcagttacgtcccattcgatctttccgttgatgaggctggagaccaccttgttttgagtcagtttgtgagcattgttgtggatgtcgttccacatgataaacttgttgaaggagaagatacctagaatagcctgttcctccacatcccatttccgctgattcttgatgcagtgccggatgatggaataaatcagttttacgttgattccgctttcgtccgtcggaagcggatcaagtcccggtacggaaatgccgaaattctgacgaagcatttctaataaggtgatattcatcatcgtttcttcttcccgcgaacgaatcacataccccttggcggctgacttgcggatgatttcgactggtagcagcaatatcggtgcataacggggacgctcgctggaaggcgtttcgtaccatttcagaagtccgagagccagataaagcgtgttcgctccgttctcttcgatagaagtacgggacgaacggtacaggtgagtcagtgctttgcccaagtcattctccggcaagtaaaaacgtaaccttttctgtgaaagctccgaattaacgaagtcggctatcggatccgattccggtatggaagaataaatgccaaattccatcgccggattctcccattcagcgggacggtggaggatacgaaactcatctccttccgccaaggcgtcttccagacaggcaaggtttgccggaatcagctgaagagtattctttgtaatccggatattcagcaagttgttgcgcagactcaaatccagcagtcttctctcccaaagcaactgtttggtgaggactgtctgagtttcgctgcccgacaaatcatacggattcacactttgcggagtggcgtgcgtggtatttctgttcatatcctcatcttcctttatttcccatacttgtccgttcagtacgcgctgcgggatcgggcggactcccgaatgcctggcccttctgatgtcgatggcgaggatgaaactgcccggatcgctcagtttgccgttagcgcttttcacggcgttgtcgaagtcggcattatgtcccatattcatgcaggtggtttctaccagcgtgatgtcgtagattccttcggcggttcgtttggtcagcaaggatacatcgtcgatggcagggtccggaaaggtttccggcaccagccagccgcctgcgaaagcatgccctttggtgatgacgatgagggcattcagtccgatggattcgaggcaggaagtataaagcagtgccatatccagacaagttccgagcttttgtgccagtacggaatctgtcagccggacacgctgcccgtgctcttcgaagctggcgggaatggtgctgtaaataatctgctgttcggtgagggcggtgtagatagctgccatctgctttctcacacggtccggattgcggctttggtattcgtccagtgacggagtaccggtccactgttccagaatcgcggcggctctcttgataataggagtgagcacggcatgattcggggtgatgaatgctgccagcatctcggggaatatattgattccgccccattggtcgtatgccagaatgtcgatggggtaggtccgggtaaagatcgtttccgcctcggagcggatttctattttcagacttcccgacatacgctcggtcagctgggcgaaataattggcggacaagaccaggctgaacgattgcagacacacggaattattggcgggaatcgcttccatcatcacaggagtgatactgccgaagtcgggctcggccgtgatttgtacctgaatgtttctgaagggttcggacgtcatattttcaatcgaaagctgatggatgaccgatactttgttttgctgcatcgcgaaattaataagtggcagataatcaaactgcaccctgattttgtccaatgttccgttcatgttgaaagtcgtataatattagattcgcaatattacaaaaaatacggatattaccatcttttctttgggtattcttttgtcggtcaagaaaatattcctacctttgcgcccgatttatagataatataatgtcttattcaattaaagtattaaacaatttatttattaatggaaaacttaaagaacgtagctcctattgaggacttcaactgggatgcttatgaaaacggcgaagctgtaacaagcgcaagccacgaagaactagaaaaagcttacgacggtacgcttaacaaagtgaacgaccgtgaggttgttgacggaaccgtaatcgcaatgaacaagcgtgaagtagttgtgaacatcggttacaaatcagacggtatcattcctttgaatgagttccgttacaatccagacctgaaggtaggtgatactgtagaagtatacatcgaaaaccaggaagacaaaaaaggacaactcgttctgtcacacagaaaagcccgcgctactcgttcttgggatcgcgttaacgctgctctggaaaatgaagaaattatcaagggattcatcaagtgccgcacaaagggtggtatgatcgtagacgtattcggaatcgaagcattcttgccgggttctcagatcgacgttaaaccgatccgtgactatgatgtattcgttggcaaaacaatggaattcaaagtggttaagattaaccaggaattcaaaaacgttgttgtatctcacaaggctcttatcgaagctgaactggaacaacagaagaaagaaattatcggcaagctcgaaaaaggacaggttcttgaaggaactgttaagaatatcacctcttacggtgtgttcatcgacttgggtggcgtagacggtttgatccacatcacagacctttcttggggccgcgttagcgatccgaaagaagtggttgaactggatcagaagctcaacgttgttatccttgacttcgatgacgaaaagaaacgtatcgctcttggcttgaagcaactgactccgcacccatgggatgctcttgacactgacttgaaggtaggtgacaaggtgaaaggtaaagttgtcgttatggctgactacggtgcattcatcgaaatcgctacaggtgtagaaggtctgatccacgtatcggaaatgtcttggagccagcatctgcgttctgctcaggacttcatgaaggtgggcgacgaagtagaagctgtagttctgactttggaccgcgaagaacgtaagatgtctttgggtatcaaacaactgaaacaagatccatgggaaactatcgaagaaaagtatcctgtaggttccaagcatactgcaaaagtacgtaacttcactaacttcggtgtattcgtagaaatcgaagaaggtgttgacggcttgatccacatctctgacctttcttggactaagaaagtaaaacacccgtcagaatttactcagattggtgctgacatcgaagttcaggtattggaaatcgacaaagaaaaccgtcgtttgagccttggtcacaagcaactcgaagaaaatccttgggatgtattcgaaacagtattcactgtaggttctgtacacgaaggtactatcatcgaaatgttggataagggtgctgttgtagctcttccttacggtgtagaaggtttcgcaactccgaaacaccttgtaaaagaagacggttcacaagctcagttggatgagaaacttgaattcaaagtgatcgagttcaacaaggacgctaagagaatcatcctgtctcacagccgtatcttcgaagatgtagctaaggctgaagaaagagcagaaaagaaagctgcttccggtgctaagaagtcttctaacaacaagagagaagatgctccgatgatccagaaccaggctgcttcaactacgctgggcgacatcgacgctttggctgctttgaaagaacagttggaaggaaagaaataatcgttatttctatataatggaaaagcgctccgattatcggggcgctttttttgttttgccatgatagcacaaataccaaaaaacttgtgtacatttgtgccgctatggagaaattcgaactacatatacttggatgcggttctgctttgcccaccactcgccattttgcgacatcgcaggttgtgaacttgcgtgaaaagctttttatgattgactgtggggaaggagcgcagatgcagttgcgtcgttcccgcttgaagttttcccgcttgaatcatatctttatttcccatcttcatggcgatcattgctttggactgttaggactgatttctaccttcggtctgttgggacgaacggcagacttgcatatccattcacccaaaggactggaagaactgtttgctcccttactttctttcttttgcaaaacgctggcctataaagtctttttccatgaatttgagacgaaggagccgacgctgatctatgacgaccgctcggtggctgtgaccaccattcctttgagacaccgtattccttgctgcggttttctttttgaagaaaagcagcgtcccaatcatatcatcagagatatggtggatttctataaagtacccgtctacgaactgaaccggatcaagaacggagcggattttgtaactcccgaaggagaagtcattccgaatcatcgtctgacccgtccttctgcccctgcacgaaaatatgcttattgctccgacacgatttaccgacctgagatcgtggagcagataaaggggatagacctccttttccacgaagctacctttgctcagaccgaacaggtgcgggcaagggaaactcatcatacaactgctgcacaggccgcacagattgctttgaatgctgaagtgaaacaattagtcatcggacatttttccgcccgctatgaggacgagtctgtattgttgaatgaagcagcggctatcttcccccaaacggttttggcaagagagaatatgtgcataaccataaataactatacagatacgagagactatgaccccttataacgaacgtgaggttctgaaactccttcaggaggagagtacacagcggaaaggatttgagttgattgtggcgcagtacagcgagcagttatactggcagatccgccggatggtactgtcgcatgaggatgcgaacgaccttctgcaaaacaccttcatcaaggcatggacaaatattgactatttccgtgccgaggcgaagctgtctacgtggctctaccgtattgcgctgaatgaatgtcttacttttctgaacaggcagcgtgctacaacgacggtggctatcgacgatcccgaagcggcgattgtgcagaaactggagagtgatccctactattcgggcgatcaggtgcagatgctattgcagaaagcattgctcaccttgcccgaaaaacaacgaatggtgttcaacctgaagtattatcaggaaatgaagtacgaagagatgtcagaaatctttggaacttcagtcggagcgctgaaagcctcctatcaccatgcggtaaagaaaatagagaagtttttggaagaagtagattaaaccttttaaagcagacatcgtctaatcaaaagagaggagaaaaacgtatgaaagaagaagataccctattgaagaaaatcggaaaggagcattccttcaaagtgcccgacggttactttgaaaatctgacttcagaggtgatgaacaaacttcctgaaaaagagaaagttgctttcaaggaagagcatgtttcgacatggacgagattgaaaccattattctatatggcggctatgtttgtaggagctgccctgattatccgggtagcgtcatcagaccataaaccggtggcagatgatatagcggtggcagtaacggctatggaagcggatacggaacaggtatccgacgagatgattgatgttgcgttagaccgtgcgatgttggatgattattcgttatatgtctatctgagtgacgcgagtgtagaatgatttattaaaacagattgaataagaaaatgaagaaactaatcgctttagtcgttttgttatgtggctttatgcctgttctttgggctgccgatggatgtgaccagcatttgtcccgtgaggaattccggaataaacagaaagcgtttattattgagcaggccggattgaccaaagaagaggctgccaaattcttcccagtttattttgaactgcaggagaagaagaagaaactgaacgatgaatcgtggagtttaatgcgtcaaggtaaagacgacaaaacaacagaagcccagtacgaagaaattgtagcaaaggtatgtgacaaccgtatcgctgccgaccgtcttgataagtcttatctggaccggtttaaaaagatactttccaataagaagatattccttgttcaacgtgcggagatgcgtttccatcgggaaatgctgaaaggcatgaaccgcaaggacggaggaaatgatccgaaaaggaagaaataaaacggaggctctgtttggatgaaacggacgttctgtcagagtaaatcagaggctctattctatgcggatagagcctctgatttttgtttccggatgaattgttagcttacctttgttgttttaatccgttctatcatgaaggcgaatggcgttacagtccttttttcttagcttcgttccaaatagcgtccatctcctcaagagacatatctttgaggtttttcccttctttaatcgtatgttcctccaggtagttgaaacggcggatgaacttttgattggttagttccaaagcattgtccggattgattttgtagaggcgtgccgcattgatgaggctgaacatgacgtcaccgaattcggcttctgctttctctttgtccatgttggctacctctgcttggaattctccgatttcttcttttaccttatcccatacctgttcccgttcttcccagtcgaagcctacattgcgggctttgtcctgaatgcggtaagccttgatgagtgaagggagtgcagcgggaacaccgcttaatacacttttgtttccgtctttttctttcagtttcagctgttcccagttttcggatacctgtccggcagtctcagcttttacttctccgaatacgtgaggatggcggaaaatcagtttgtcgcacaacttgtcacagacatctttgatgtcgaagtctcctgtctccgaaccgatctttgcatagaatgctacgtgtagcagcacatctcccaactccttgcaaatatcttttttgtcatccctcatcaaggcatcacaaagctcgtaagtctcttctatagtgttggggcgcagactttcgttcgtctgcttgcggtcccacggacatttaacccgaagctcgtcgaggatgtctagaaagcggccgaaggcttccatttgttcttctcttgtatgtatcattcctttgattttttttataaataatgttgcaaagataatgcttccttgtcttttatagccttaatcggtacgaaaacagaagcaagggcgctaataaaagtctttttattggtctgatgaggttttcgctttccatacttgatacgaaatcaacagcccgatcacttccgaatagttttttcttccgctttctattttgtttcctttcaggtagaggtcgtatatccagttttgaacatcaccgatcaacggactgtatttagccatccagtattcctgattctttttcgccagttctataatctccggtcggatacggttgattatatcggcgtattctttttcactcaacagtcgtcgggcattccccagtacatgattcagaatcgagaagtagccgctgaaacggattccctttatttgtgaacgggtacaaacctgataggcatagaaattggcctctgcctcgctcgaaattcccagcagatgagccagttcgtgagtgtacgttgccggatagttgatggggagcaagtctccgtttaaggtgaattcgcagaagaaaggccccatgcttcccgtcactccgaccattgatatgaatggggtgaaaaccatcgtcttgacccgtgggttgggaaatggagggcggtgtactcccaggctgtcgcttaattgattgtaaagtttgacagcttcttcacgtacctgttcctcatgtattccttttacgggaacaaacgaactgttcagtgagtcgatatagttatccacaaactcttgaaaaatctccggtgtgtaagctgtataaggaatatgcgtacgctggtaaaagtttggctgcgaatagtttaacccccacgcgaggtagaaccatacgtaaacccataacagatattctccgtcacgtagcagaatccttttccacggcagtttcttgcggatacgggcataaaaaggataaacgatgactcccgtgatactcccgaaaataaatagatcccctatggcaaaaggaaataagttggagaagaatgacaaaacgcgggagatgacaggataaacggtttgtgaatacaggtttcccaacgcgggaatcgactgtgtcatccataccagaagcagcagtactcccaggagtatatatctaattatcagtttccgtttcatcatccgttcagattttagtcaacaaaaatatgcattaaataaacgtcacgcgaaaaaatacctctatatttgcaaaaaaactgttaaacgaaagatggctaccgtagaagaaattgaaaagtattgccggaattgcgtgtcacgtgatttcgtgaatgggaaagggcttgtttgcaaacgtaccagagagcttcctgactttgacgaagaatgcgaaaacttcgagaaggatgaagaactgttgaagatggctcctcccaagcccgacgactttccggtgtcaatgacggaagaagaacttctcgccgaagaaaatcttcccaaaggagtgctgtatgcatccgtcgcgtgtatcttgggggcggtggcatggagtcttatctccgtttctacaggtcttcagatgggatatatggctatcggagtcggattcctggtcggtttcgccatgcggcaggggaaggggatacgtcccgtcttcggtattttgggagcggtactggcattgatcagttgtgtgttgggtgatttcttatccatcatcggctttgctgccaaggattatgatatgacgtttttcgaagtgctgacgggagtcgattatggcgaaatcttttctgtcatggtgaagaatgtggtgtcgatgtccgccttattttatggaattgctgtttatgagggatataaattatctttccgggcacagaaacatcctgtgggtggtaagatttgaattaaaattattaattttgcagccgttattttttgaatatacattatcatatacataaagaaacatggaattagcaagtaagtacaatcccgctgacgtggagggaaagtggtaccagtattggctggaacaccgtttattcagttcgaaacccgatggtcgtgaaccttacaccatcgtcattccgcccccgaacgtcaccggtgtgttgcacatgggacacatgcttaataataccattcaggatattttggttcgtcgtgcccgtatggaaggcaagaatgcctgttgggtgccgggaactgaccacgcttccatcgctaccgaagcaaaagttgtaaacaaactcgctgcccagggcatcaagaagacagacctgacccgtgatgagttcctgaaacatgcctgggactggacagaagagcacggaggcattatcctgaagcagctccgcaaactgggtgcatcctgtgactgggaccgcaccgcctttactatggatgaggaacgcagcaaaagcgtattgaaagtatttgtagacttgtacaacaaaggattgatttaccgtggtgtccgtatggtaaactgggacccgaaagcgttgactgccctttctgacgaagaagtgatctacaaggaagagcacggaaaactgttctatctccgctataaggtggaaggtgatccggaaggccgctatgcagtagtagcaacgacccgtcccgaaacaatcatgggcgatacggcaatgtgtatcaaccccaacgaccccaagaacgcatggctgaaaggaaagaaagtaatcgttccgttggtaaaccgtgttatccctgtcatcgaggacgattatgtggacattgagttcggtaccggttgtctgaaagtaactccggcccacgacgtaaatgactatatgttgggtgaaaagtataatctgcccagcatcgacatcttcaatgataacgggactttgagcgaagctgccggattgtatatcggtatggatcgtttcgacgtccgcaagctgattgagaaagacctcgatgctgccggattgctcgaaaagacagaagcctacacaaataaagtaggttactcggaacgtaccaatgtagtgatcgaaccgaaattgtctatgcagtggttcctcaaaatgcagcattttgccgatatggcattgcctccggtaatgaacgatgagttgaaattctatcctgccaaatataagaatacataccgccactggatggagaacatcaaagactggtgtatcagccgccagttgtggtggggacatcgtattcctgcttacttcctgccggaaggtggctatgtggtagccactactcccgaagaagcgctggctaaagccaaagagaaaacaggaaacgccgctttgacgatggatgatcttcgtcaggacgaagactgtctggatacttggttctcttcctggttgtggcctatctccctgtttgacggaatcaatcatccgggtaacgaggaaatcagctattactatccgaccagcgacttggtgaccggaccggatatcatcttcttctgggtggcacgtatgatcatggcgggttacgaatatgaaggaaagatgccgttcaagaacgtttactttacagggatcgttcgcgacaagctgggacgtaagatgtccaagtcactcggcaactcacccgacccgttggaactgatcgacaaatatggtgccgatggtgtccgtatgggaatgatgctggcagctcccgccggaaacgatattcttttcgacgacgcgctctgcgaacagggacgtaacttctgcagcaagatatggaatgccttccgtctgatcaagggctggacgattgacgataatattcaggctccggatgccgctaaactggctgtccactggtttgaatccaagcagaacgaagtagctgccgaagtagcggacttgttcagcaaataccgtctgagcgaagcgttgatggctgtctataagttattctgggatgaattctcttcctggtatctggaaatgattaaaccggcttacggacagggaattgaccgtaccacttatagcgctactctctgcttcctcgataacctgttgcatctgcttcatccgtttatgccgttcatcacagaagaattgtggcaacagatgtacgaacgtaatgcggaagaaggagaaagtctgatggtaagtgcattgagcatggatacttatgtagacaccgcattcgttgcacagtttgaagttgtcaagggagttatcagtaatatccgcagcatccgtctgcaaaagaacatagctcagaaagaaccgcttgacttgcaggtgctgggcgaaaatccggttgcagagttcaatgcggtgatccagaagatgtgtaacctttcttccattacagtggtagagagcaaggcggaaggtgcttcttccttcatggtaggaactaccgaatacgctgtgccactaggcaatatgattgatgtagaagccgaaatcgcccgtatggaagctgaactgaaacataaggaaggattcctgcaaggtgtattgaagaaactcagcaatgagaaatttgtcaataacgccccggcagccgttctcgaaatggaacgtaaaaaacaggccgatgcggaaagtattatcagttctttgaaagaaagcatcgcagctttaaaaaaggcataatgaactgatacataaaaatatgtaatagagaggcatcccgatagatttgggatgcctttctttttaaaagataaaaataatactatctttgcttccacttttaatcacacagcaaaatgaaacaattactgcgaatatgcttaacaggtgcgttctttcttcttttcgaaggactcctttcccctatgttggcagataatgggagatcagataaagaaatattggttttgaattctatcaacttcaaccttccctgggccagaaacttctattggtatgtgcacgatgttcttcaggaacagggaataaccgccagagcggaatcattgtctgtcccggccttgcaggatacgatggaggtaaatgcggtcatcgagcatctgcgtcagaaatatccgcttcctcctgccgctattgtgataattggtgatccgggctggattgtctgtcgtcctttatttgacgacctgtggaaagatgttccggtgatcataacgaactcccgtgaccgcctgcctgctaccttggaggttctgctctctcatgccccgttgaatgaaaccaacagcgtccccgcccaagaatggagaaaaggctacaacctgactaccctgaaacagcattactatgtgaaggaaaccgttgaactgatctatagcctgatacctgatatggatcgcctggcatttatctcggacgatcgctacatcagtgaagaaacccgcggagacgtgaaagaagctgttgaaaagcatttcccaaacctgcctttagaattgctttctaccactcacttgtcaacagaaatgcttctggacaccttgcgcagctataaggcaaacaccggaattatttattattcctggtttgagtcgcataataaagaagataataattatctttttgatcatattcaggagattatcaccaattttacgtcctctcccttgttcctgctttcttccgaagacctgtccaataatacttttgcaggaggctattacgtttctgcggaatcattcggcgattccttgcttgagattattgaccgtgtactgcatggagaacaggcggaggacattcccgaaagtataggagggaaggcgagtgcctacctctgctatccggtgctggaatcctacaatattccctatcacctttatcccgaacgagctgtttatgtcaacgaacctaaaagtatatttcatcaatactgtgttgaaatcctttcctgttccatcttccttcttattttgatagcagcgatcacctattatatacgtatccttcgcaaggcatacactcgtctgagtgaggcaatggaaaaggcggagcaggcgaatcagttgaaatccgcctttctggctaatatgagtcatgaaatccgcactccgttgaatgcgattgtcggcttctcgaatatgttgccggatatagaagatcgtaaggagatgcgcgaatatgcggacatcatcgaaacaaataccgacttgcttcttcaactgatcaatgatattctggacatgtccaagatcgaagccggcacttttgacttctgcccgtcattgatagatgtcaaccagacgatggaagaaatcgaacagagtatgaggcttcgctcgaaaaaagaaactgtcactcttacctttaccgaacgtctgccggaatgtaccctttatacagataagaatcgtttgatacaactgatttccaattttgtgatcaatgctattaaatttactcagacaggttctatcagaatgggatatcgtctgaaagatgtcagtacaatttgcttttatgtttcggatacaggctgcggcatgtcggaagaacaatgcaggcatgtattcgaaaggtttgtgaaatacaatccttttgttcagggaacaggtttgggactttccatttgtcagatgattatcgaccggttaggagggacgattggagttgaatcggaagaaggcaaaggctctactttctggtttacgctgccctaccagcaggaatagcatcgtatttgtcttcttatcctttatgattgttagttttatgtattgcagacttccaagactttgatcagcttattacgatgagacaatattctcaccgcaatgagaaaaaattctcaatgcaatgagaaaagattctcactgcgatgagaaaaagttctcactgtggtgagaaaaaattctcatcatgatgagaatggttgagaatttatgatctgtatcagcttgtactatagataaatacagatttactgctttctgttttatagctttaattgatagagcaaaaaagaactttacctaaaaagagaccgtttttctctatttagttgaaggatggtataggtataataggtgcgaatccaatttattggaaggagtcacttatattaaggaaacagtaaaggaagcagcaatggcagataatcttttaaatcgatgcgtaattgcttgagtgcttgctgaatacgataatctacagcctttggagacactcccaatgtttctgcaatttctttgtagctcatatcccggaaacgatgcataacaaatgcttgccggtaactttccggtaatgcggcaaccgcctcttcaatacgtttggttagctctttaagttgatagaagtccatatcctgtatcatctcttgcatttcttcatagaaacgcgtatcagcacgtttgatggcatcaatgtgtgcaagtttatttaaagccttgtgatgtaccattttaaagagataagaacttaatgatgattcaataattaggttttcccggttttcccatatccatagaagggagtcttgcacaatttcttctgcatcgtgaaagtcaacatatttatgaccataggcacatagcactgcatagtattgcctgaatagcgtttcaaaggcttttaggcctccacgctgtatttcagataattgagggtcattcctctttatgcgtagttccttcatttattaaattctaatttactgcaaatatagcttttttataataaaataaagattttctgaaaaaaataaggttttcgtttaggaatgccgtggtttggtcttgtcatataataaaaggtagaataaaggatgaaagaattagataataatagaatagaagaattgcttcctcgttattgtgaggggaggctgagcgagggggaacgtctggaagtggaagcgtggatggacgagtcggaggagaataaacgagttgctactcagacttttgctctttatttggctgtggacacggttcaggtaatgaagaaagttgatacggagaaagctttactgaaagtaaagggaaaaatgtcggaccgtgaagtgagaaggacagtgtggtgggagtgggcacaacgtgctgctgcaattctgtttattccgcttcttaccttattaatatggcagaactggaaaggggatgccggagaggtagcggagatgatggaagttaagaccagtcctggaatgacaacttcgttgacattacccgatggtacaattgtttatttaaattcggaatcttctttgtcttatccttctcgctttaatggggatttccgtaaagtgacgttaagtggtgaagcatactttgaagtagccaaagatccgaaaaagaaatttatcctttctactacacatcaatcacagatagaagtattgggtacatgtttcaatgtggaagcatatgaacagaatacagaggttattacaactttgattgaagggaaagtagattttatgttcgagaaagatgctgggatgaaacatgtgttcttatctccaagagagaagctggtgtatgattcggagactgataaagtccacctttataaaacttcgggaaaatcagaattggcttggaaagatggagaagtggttcttgataatacacctttggaagaagcattatggatgctggaaaaaagatatagcgtgaaattcgttattaagaacgaaaaactgaagaatagctcgttcacgggaacctttacaaatcaacgtttggaaaagatcctggaatattttaaagtatcctccaaaatacgctggaaacatatcaatgatgacaaggatggaagtgacagaaaaaaagagataatagagatttattgattaacctttaacaatttaatagtatgaaagcaaaacccacttagaaaaaagtatgggaagattttggcagatctccccatactaaaatgaatcaattgaaaatgcttgttggcagacaagcatagttaactcattttcaacttaaatcaatacaaaattatgcaaaacaattttagcatccaagttttaagggtggtaaagtctttttggctaacctcgaaaaaaatcccacgtactatgagactggttattttattcttattttgttttgtcggattaactaatgcgacagatagttatgcccaatctgcaaaggttacgatgaatgtacgtaatcagacagttgaggatgtattaagagcgatagagaagcaaacagaatttagtttcttctacaacaatgctcatataaatttgaaacggttggtgacaatctccgctgaccgtaatgatatctttaaagttcttgacgaagtatttaaaaatacgaatgtagaatataaggtaatagataaaaagatcattctgtctacggagttggcatctgtcgaacaggcgcatcaggaaaaggtaaaagtaagcggacgagtggtggatgcggcaggtgaaccggtaatcggtgccagtgtgatagaaaaaggctccgccaatggtacgatcactgatatggacggtaattttatcctgaatgtcggttcaaaagaagccattcttgaaatctcttatattggttatcaaggacagtccctgaaagtaactccgggaaagacgctgtcggtagtattgaaagaggacacacagagtctggacgaagtggtggtcgttggttttggcgtacagaagaaagcgaacctgaccggtgcggtatctcaggtaaagatggatgatgtgctggggagtcgtcctgttgtaaatgccatgagtgctttgcagggtgcgatgccgggacttcagattactcctaataatgatgctgccggtccgggacagagcaaatcattcaatattcgtggtacgacttctatcaatggcggtggtccgttggtgttgatagataatgttccgggggatatcgatatgttgaatcccgaagatatcgaaagtgtttctgtgttgaaagatgccgcctcggccgctatctatggtgcgcgtgccgctttcggtgtaatacttgtgactacaaagaaggcgaagaaaggcgacgggtttcatgtcaattataataataattttggtttccagagttctatcaatcgtccggaacaggctgacgggctggagtggatgcaggcttacctggacggcgagttcaatgccggtaaatactacaccgggcaagatatcaaaacctggatgaactacctgaccgaatatcgtaagaatccgggtaaattccagactaccggagacggggtatacgtagatccggaaacaggattgaattattacctgaatgagaaagacctgtatgccaatatgcttgatgattacggttttctgcaagcgcataatgtgtcattgagcggtggtactgataagctggcttatcgtctgtcccttggttataatagcgagcaaggtattttgatcaccgataaagaccgctacaaacgtttgtcgggtagtgcctatatttctgccgaaatcacctcgtggctgactcagtctgtagatatacgctatgctcagagtgacaagaatatgcccgtgacttcggataagaccggattgtatgatatgcgtttgccggttgtatatcctgaaggttccctgactttgcctgacggcaccagcctgatgacgaatacgccttccaacgttttgagaatggcaacggataacaatacaatcagagacaatgcccgtatcctgtcaaaaacggtattgaaaccattgaaagggcttgaagtggcattcgaatatacatttgacaagacatggagtaatcagaatgtgaataaggcttccattgattatacaacggttgagctggcaaaaatacagactgccactacctcttctctggagacgactcaccaaagtactgattataatgccatcaacctgtatgctaattatagatattcatggaatgacacgcataacttgtcattaatgggcggcttcaaccaggaatccagtgactggaagaaactgtatacttattcttatgatatgattaacgagaagtatccgtcacatagtacggctaccggtgagaataaggttattacagacgatcatcgtgtgtatactgtgcgtggcgctttctatcgtattaattatgattataaaggcaaatatctgtttgagaccaatggtcgttatgacggctcgtctaaattcccgaagaaaaatcgtttcggtttcttcccttctgtatctgtgggttggaacattgcccgcgagaactttatgaaaccggttgcaggtgactggctaagcgatctgaaacttcgcggaacctggggacaaataggtaatcagggtattgatccttataaatttgttccgaccatgtcgcaagtggaaaagaaggatgtggcatggctggtgaatggagcgaagccgctgactttgaatgctccgggactggtcagtgatagttttacttgggaaactgtagaaacattggactttggttttgatataactgccttgaacggacgtctgcaaagtactttcgactggtatcgccgtgatacgaaagatatgcttgctccgggagctgagctgccgtcagtggtaggtgcttccgcacctttgcagaataccgccgacttgcgtacgaaaggctgggaattgtcattgacgtggagagatagaatcggtgcatggggctataatgtaggcttcaatctttatgactctaaaacagtcgttaccaaataccataatgaatcaaagattatcctgaaaagtgatggcacgaataattattatgaaggatatgaaatcggttctatctggggttatgtaacggatggttactatacagccgatgactttgaagatacaaatacctggaaactgaaagaaggagtggtgacagtggatggagtaagtccgcgtcccggagacatcaaataccagaatttgcgtgatgatggatcgagtacgaatcgcattgatacgggagacggaacctttgacaatccgggagaccgcaagataatcggtaataactctttgcgtttgcagtatggtataaacctgggagtcaattacaaaggatttgatctgagtgttttgctgcaaggagtaggtaaacgtgatgtatggattagtgatgcacgccgctggccgtttaattccggacagttcggttcactctttaaagaccagctggattattggaaaccggtagattctgccaatggcgactggacggcagccaatccgaatgcggaatatttccgtatttacgggcaaggaaacaactccggttacaatacacgtgcgcaaacgaagtatctgatgaatggctcttatctgcgtgtcaagaatgtgactttgagttataattttccgaagagctggttggcacctattacattaacgagtttgaaagcgttcgtaagttgtgagaaccttcacacatttactaagctgatgaagggttatgacccggaacgcctgtcttggggatatcctttctatcgtacgatttcttttggttttaatgttactctttaatttagaattggttatgaaaaaaataatatatactatgcttgcggcagcagctatcgggtttacttcatgcaacgatagttttatggaacgctatccggatacttcgttgacggagcagacagtgttcagtaattataatactttcaagacctatgcctggggattatatggagtatttacaaatactaatatcctgcgtattcccggtacaaacggagcctatgccagtgccacatcctatacaagcgatatttatgcaggttatctgatgcgtcgtcagggtgacggtaatccgtatgcttttcagaatgtatccagttcgtcatcgggcaatggatgggcattcagtttcgtctatcgggtcaatgtcatgttggcaaatatcgataattcagggatgacggatgcggacaaggaacattggcgttcggtaggatatttcttccgtgcctattattattcggaactgatagctcgttttggcgatgtgccttgggtagatcgcgtactgggtgattcggataaggaaatagcatatggtccccgtacacctcgcaaagaagttgccgatcatgtattgaacgatttgatatacgctgaagagcatataaaagaagaaggtgacggtgaaaatacgatcaatgtgcacgttgtccgtgctcttctttcccgtttctgcctttttgaaggtacatggcgtaaatatcatgctttgggggacgaagataaatactttgatgcttgtatcacttattccaagaagctgatggattcttatcccgaactgaatagtgattggggagagatgctgacatctgacctgaaaggaatgaaaggcatcattctgtataaggaatatgtagaaaaagaactgacaaattatgtactgacgcatgttgaacggacatccacccataatgtggaaatgccgcaacacatcatcgacatgtatctttgtaaagatggtaaaacgattcataacagctcggaatatgaatggtcgcaggagggggataatagtatgaatgctaccttccgcaatcgtgaccttcgtctgctggagactgtagctcccccttataaggtgatcccaagtgccgataataccagttgggagtatacctccgatcctaaagaccgtgagtttatggatatcatgggcattacccgttacacaggtttcgggggtggaaatggggaagccggtaaacataaagtgttcccattgatgaactggtctgctgctatattgaaagggatgcctcacttcttcaccaacaatggcggacaaggtttcctcgtagcccgtagcggtaactatgtgtacagatactataatgtttgggataattcgaaagagaatgaagggacctcagatgtacctttgttcaagattgatgaagtgatgttgaattatgccgaggctaaatttgaaaaaggtggtacaggtgccgagggcttcaatcagactgttgctgatcttactatcaataagttacgcgatcgggtgggagttgcccatatgaaagtagccaagataaatgccggatttgatccgaagcgcgaccagaccgtagaccctgtattgtgggagattcgtcgcgagcgcatggtagaattgatgggtgaaggatttggattctacgatgtgcgtcgttggaaaaaggcaccttggtttatcaataagatacagtacggtcaatgggcgactaaagagcagattggcgactccggacagtttgttgatcttgaaaagggatacgccgatacgacaggaaagaaagaaggttttatctatatgtataatgatcctttggtagcaggtaaaggttggttagataagtattatctgtatcaggtgcctactaatgaaatcgcattaaacccagaactggcccccaataatccgggatgggagtaataattaactgaaacacaaattgaaagaagatgtgcaaataactgtttgacacatcttctttctttattagagccaatgctatacgtcggaaacagtcggtgagtcaaccgaatatttccgacttttcatatattggaggttatttaatgtgtatcagtataaaagaactacattttattttcagtaatcggaaatttgaaatatatttagaggctcaaacgcccaaacacatttgatgacccttaaaaaaataatgactatgaacatgcgtcttctattacttttattatttggttctgttgttatgtatacaagttgccaatctacgtctgctccaatcgattcattggcagcacgtgtgacggagaatacgtcgaaagatcaaatccttttccggttggttactgatgaaaccgccccggcaaaagactactttgagatagactccaaggatggcaaagtactgataaccggaaactccgatctttcactggctacgggcttgaattggtacctgaaatacgtggcaggtattcatctttcgtggaataatccctcgcagaaattgccggaagtactgcctctgcctcaaaagaaaatccgtcaggcgacggctatgaagaatcgatattacctgaattactgtacctattcttactccatggctttctgggactgggagcgctgggagaaagagatagactggatggcgatgcacggcatcaatatgcctttgagtataacagggatggaggttgtctggtataatctgctgaagcgtatcggatatacgacggaggagatcaatgagtttatttccggtcctgcctttatggcatggtggcagatgaataatctggaaggatggggcggaccgaatcccgacagttggtatcggcaacaggaagcactgcaaaagaagatcattgcccgaatgagggagctgggcattgaaccggtattccccggatatgcaggaatggttccccgtaatatcggcgagaaactggggtatcagattgccgatcccggtaaatggtgcggtttccctcgtccggcttttctttctacggaagatgaacatttcgattcatttgctgccatgtattatgaggagttggagaaactgtacggaaaagcaaagtattacagtatggacccctttcacgaaggaggaaatacggaaggagtagacttggcaaaggcgggaacttctattatgagtgctatgaagaaagcgaatccggaggctgtgtgggtgatgcaggcatggcaggcgaatccgcgggaagcgatggtcaacacgctcgattccggtgatttgctggtactggatttgtatagtgaaaaacttccccaatggggtgatccggagtcgatgtggtatcgggagaaaggtttcggcaagcatgactggctttattgtatgttgcttaactttggcggtaatgtcggtctacacggacggatggagcaactggtgaatggatattataacgcctgtgcacatgtcaacgggaaaaccctgcggggggtaggagctactccggaaggaatcgagaataatccggtgatgtttgaattgctgtatgagcttccctggcgggaagaacgtttctcaccggatgtatggctgcaagcgtatctgaaagcgcggtatggaaatgatttgtcaccggaagtagcggaagcatggcgtgcgctggaacatacagtttacaatgctccgaagaattatcagggagaagggacagtcgaatccttgttgtgcgcccgtccgggatttcatctggacagaacgtcgacatggggatatgccaagttattctattcatctgattcaacggcaaaggcagcccgcttgttactttctgttgcagatcagtacaagggaaataataactttgaatatgatttggtggacgtggtgcgtcagagcctggcagataaggggaatgtgctgcttgaagaaatttctcagagttatgatcggaaagataaggatagcttcgggaaacagtcacaacagtttttggagttaatattagctcaggacagtttgctatccacccgaaaggagttctcggtgtcttcatggctgaatgccgcacgttctttgggaaccacggaagaagaaaagaaactttacgaatggaatgcttctgcgctgatcacggtctggggagacagtatagctgccaatcagggaggtctgcatgattattcccatcgggagtggagcgggattttgaaagacttgtattatcaacggtggaaaactttctttgagcagaaacaacgggagttggatggtaaacttgaccaatcagcggaagaaccgattaatttctatggtatggagaaagcatggacggagaaaaacaaaacaaatgattcatcggatcataagtcacaaactgtaattgaaacggcaaaatctgtttatcggacagcgattgaagcaaagtaatttatctacctacactgctccggctttcagctagagggctgactaaaaagtcggtagtgccttaaatgggagtgactaaaagtcgatagtattttagttctcctccttcgggaaggaggagtggtcgaagaccgaggtggtaggataaataatgttcattcctatttgattgaaaatgaaagttttgtgtgttcacctaccacctccccctacggatactcctccttcccgaaggaggagaattaaggcactatcgacttttagtcactcctgatagggaaacttgggtttgtacgaatcatataaaacgaaaaagaataatcagaagtaaacaggggaataccttttacttccgattattctttttataaatgataattgcttcggcaaggccatgccgggcaatcgaatatatttatttctccaacaaatttttcagaaactcgtccagttctttatccagtcctttcagcagttcgtcatccacgagcaatgtatcgtcatctatcagcaacagctctgcaactgtttccttatcttcatctaccagtacgaatgaataaggctttaatattgttactttatcgaagtctcctgcatctttcattctgcaaaggatacttttcaggttgggctctacattttccatgaaatcatctccatcgtaagtcgcccactcttcaatcattacattagccaattcctcgtcatcgtcgttataaatagtgagttgtcccgatgtttggtccggttgtaaatgaatatcggttacggctgtctggtcgcagccacatacatatttgccggctgccttttggatagccgattcgatggtagacagagattgttggctcagtttcataggttcttcctttttgttacctcaaaggtataaaaaaaataataatcaatgcatgatttccttaaaaatcatcattaaatcgctccatttgcatttttagcttgggcaattgactgttacgttcctttaattcatttgcataaagggttgtaagatagtaattcggtacatcgtcaatggtggcgtacgccgcattttcgggaatgtttttcttatctactttttgggcaagttgctgtgctttgactgcccattcttctgcttttgccaagctgtctttcatctcataataaacagcgatattgagggcagctttcatctttttcttttccttcttggttccgttgtacacttgttcccaaagttcgaaagccctgtcccatgaattttcacggacaaagattgccgcgtcacgcatctgtacggagccaccggtgtacaagtatcgtttgcctgtcttccagaaagggagtagctgtttgacagggatagtccctgcaaattcagaagcttcccgtagcatctgtgcatcaggtatcatgtgtgcaaatgtttctgttaccgatcctccatattcttcccaaaagatactgtcggtggggtgtagcgtagtcatcggtttgctgcgtgagggtagatatactttcactgtcggataggcttttacatcaaccgtccccaggtaacaattgaagtcacggaggtaacgaaccgttttggtcgctttgaattgcaggttttccattgcgatgatacagtccactcccaagtctgatgtcagctgttggacttcctcctgactcagtgtactttcacgaggaaacttgtcattggcccgtaaagcggaatcacagatcaccactacatcgaaatagttctgatgcgcgatttcttccgccagcgattcagccgcaatcttaacgttaccattggcatacgctgtggcgtggcttatttcgggtacgttttctttcggcttttcggtctgtgtgatcagcttgttatccggttcggtgctggtgttattcacgatagccactttacggagttgagaagggaaagtcatatctccgggctgcatatagtcaatagaaatctgctccaggctctgacagctgccgagtgccaacagtagcagagaaacaaatgccagtgaatagaattttgccatagtcttgatatctttagtagtttaagcaaaagtactattttggatgaataaaagaaagcctcaaacagtttttaaccgtttgaggctttcttttagattataatcttacatcggactgctgttaagcattctgtccgtggcagtttttatatttcttaccgcttccgcatgggcaaggatcattgcgtcctaccgtcttttccgcacggatcggttcgcgtttttgttgctcgcgagtatcctgactggcagcagcctgctggttcggatcactgaggtcttgtttctgttcgcgatacttgctcatatcctgacgttgctcgggagcagcctggcgtacttctacgcggcgtggctgttgttcgtctgccggagcttcctgtacagggatctgtccgcgcatcagaatggagatagtctggttattgatcttgttcaccatagcgtcaaacaacgttacggattccagtttgtagatcaacagcgggtctttctgttcgtagcttgcgttctgaacagagtgtttcaactcatccagctcacgcaggttttctttccatgcttcgtcgataacgtgcagcaggatagacttttcgaaagctttcaccacctcctttgattcggactcgtaagccgctttcagattgcaggagatgttatacatccgttttccgtctgtgataggaatcagaatgttttcgtacatatgtccctggttttcgtatacttgtttgatgaccggattagcgatttgtgccaggcgttccgttttgcgtttgaagttttccatggcaatgttgaatgtcttttctgccaatgtgtccttcttttcattacggaattcttcttcggtgaacggagtttccatagccaatgtctggagcagttccatctgacagccttcgtagtcattgttctcgatcgcattcgcgcaacggtcccagatcatattaacgatatccataccgatacgttcacccatcagggcgtggcggcgtttggtataaacaacggtacgttgcttgttcatcacgtcgtcatattccaacagacgtttacggataccgaagttgttttcttccaccttcttctgtgcacgctcgatagagttggagatcatcttgtgctcgatcatttcgccttcctggaaaccgagtttgtccattacactggcaatacggtcggaagagaacagacgcatcaagtcatcttccagtgacacgaagaatacagaagaacccgggtcaccctgacgtcctgcacgaccacgcaactggcggtctacacgacgggattcgtgacgttccgtaccgatgatggccaaaccgcctgcggcttttacttccggactcagcttgatgtcggtaccacgacctgccatgttggtagcgatggtcactgcacaactgaaaccggcttttgctacaatttcagcttctttctggtgcaacttcgcattcagtacgctgtgttcgatcttacgcatggtaagcattttgctcagcatttcggagatttctaccgaagtcgtacctaccagtaccggacgtcctgcctgcactagtttttcgatttcttcgataacggctttatacttttcgcgtttggttttgtaaacgcggtcgttcatatccttccttgcgatcgggcggttagtcgggataacgactacatccaatttgtagatgtcccaaagttcgcctgcttccgtttcggcagtaccggtcataccggacagcttgtgatacatacggaagtagttctgcaaagtgatcgttgcgaaggtctgtgtggcggcttctactttcacacgttctttcgcttcgatagcttggtgtaatccgtcggagtagcggcggccttccatgatacgtccggtctgctcgtctacaatcttcacctgtccgtcgatcacaacatattcgtcatctttctcgaacatggtgtaagccttcagcaactggttgatggtgtgtacgcgttccgatttgatggcgtagttagtcagcagctcatctttcttttccagcagttgttcgttggtcaggttttgattttccagttcggaaagttgtgcggcgatatccggcagcacgaacaatgtcgggtcttcggagttaccggtgatcaggtcgatacctttatctgtgaggtctacgctgttcagtttttcttcgatgacgaagtacaacggttcggtcacttcgtgcatacgcttgttgttctgctccatgtagatttcttcggtcttcagcatgccggctttgataccctgttcactgaggaacttgatcaatgccttattcttcggaagacacttgtggctacgataaagggcaaggaatccttcttccacttccttcttgtcgttggaggcaatcagtcgtttggcttcggagaggtatttggttgccaatgctttttgagcttctaccagacgttctaccagcggacggagctgttcgaacagttggtcgtcgcccttcggcaccggaccggaaataatcagcggagtacgggcatcgtcaatcaataccgagtcaacctcatcgacgatggcgtagttgtgctggcgttgaacaaggtctttcgggctgatagccatgttgtcacgcaggtagtcgaaaccgaattcattgttggtaccgaacgtgatgtcggcaaggtatgcctgacgacgggcgtcggagttcggctgatggcggtcgatgcaatctacgctcaaaccgtggaacatataaagcgggcccatccattcggagtcacgtttggcaaggtagtcgttcacggttactacatgcacaccgtttccggtcagcgcgttcaggaataccggaagggtagcaacgagagttttaccttcaccggttgccatttccgcaatcttacctttgtgcagaacgacaccaccgaacagctgaacgtcgtaatgaatcatgttccataccgtatcattgccgccggcattccagtggttctggtagatggctttgtcgccttcaatgcgtacaaagtctttggtggcagccagatggcggtcgaattcagtcgcggttactacgatttcttcgttttccgtaaatcgtttggcagttgctttgacgatagagaaagctacgggcaatacttcttccagtgctttctcgtatttttcgagaatttctttctctatcttatctatttgtgcaaagacttcttcgcggtcttccagttcggtgctttcgatgctcgctttaagttcttccactttagcgcgttcgtcagtagccgattcgcggatgtattttttgagttcttccgttttggcacggagggcatcgttgtccagtgcttcaatctccgggtaggcagctttgatcttttctacccagggtttgatttctttcatgtctcgtgtggatttgtttccgaaaatcgagcttaaaaattcattaaatcccatgttgtattatttagtttattattatttcttgattgtctgcacggtgctttttccatatataaatccgcgcaaagttacattaaaatgctgatttatttatgtttttcgcatggtttttgtgaggaatcttttaccgaagatcggtaataggagccgaagaagaagcattgggagcccgtatgcgcatgaaatgagccagtgtaggcgcaatatggtcgattgttacaggtgtctgaatgatggccggtttcacggagtgacccatgaagatcagcggtgcggggatataggaatgacgtaccaccttgttctcgttgccgttttcgctgacgatagtccatcccggcaacacgtcgatcacgaggtcgccggaacgcttgcggtgatagccgttgcgtattctgtatatttccggagtccatgaacccaggagaagtcggtgggcggaatatgcctcatttactccgctgaactgcatcaggaagtcggcagacttttcctgcacttctgtcaggttcagttgcttttgttccagtaacttgtggttcagatagatttgctggtcgtgataggcttctacatattttccttcgccgtaagtggccatcagaaacatgttcagcaaggcggtgcagcggttgaggtgaaactctccggtcggtattttgtacagtcccgaatccgtcgattcgctgtccgtatatccggtggaagtgacgaagataagcacattctgcaagcctactttcttgtcgagcaggtcaagcaggttggcgatgctgcggtcgaggcgtacataagtgtcctgtatttccatggcacactcttgtacggacttgtgcgcatagttgcctgcataataagtaagtgccaataagtcagtaatgtcatccatgccgaccgaacctttgccgattgcttcttctgcgagggcatttacttcatcgttgacgaacgggctggtgatgaaacggcggaacttattgttgcggtcgtcgtcaaatttatatttgaacactacgtcccgccaatctggcaggaaagtgtacataccacgtgggaaaaccggttcccatgtgacgctggagatgcgggagtcgatggcctgacggtcgttatattggcttgcccaccaggggaattcgccataataagtcgttccgctccattttccggtcgtgggattgatccagaacgctccgtttcctgcatgtccggcagcgaaaatggctgcgtcgcagaaaggggcgatggcgtatacgatacctttgccttgtgtcgctattttcagttcgtcggcaatggtagaggttaataatttggtaggggcacaggtctgatcggtgtaataacccatgaaggccgcatcgtccgtactgttgacagggcgtagggtagctacatccatccatcggttggaaatgatcccgttgacggaaggcgttgatccgctgtagatggctgccatggcagaggcacggtctacaccgctgaatgtatattctgcattgtggaatactcttccctctttccaaaggcgtttgaagcctctctcgccgtagagcgacgaaaaagcttccagatagtccgtacgcaactggtcaatcgtgagtcctaccacaagtttaggggcagtaggcaacgactgagcttgtagcccggtgaaggtcagtacggtaatcagggaagttagtagtcctttcattatttctttttagaggtcaatatcaaattgctcgctgaacgtatcagcaaacagagtgccaaaggtacaacagctaagtcaaatctctgcggaattagcggaaaaagcaccataaaaagtgttaaaacgactaaattcagcgtcaaataccagcatttctttccttttcggacacaataaatgatgtatggaaggagcagaagctgtcccggatggaataccagcaataagaaattggagctgacagccggatgttcggagaatagggcgaggaaggccagcacacagcccacgatgcctgcggcaccgaataaaataaggtcgacaccccagagtcctgtccttttgcggatgctgtagatagtagcagctgcggtaagtataaaaagcaggagggaacattggaacggggtgggcatccaaccgccttcttcttcctcgggaagggcgtctacgatcagctccttgccggatacgagcggacgctgaaccgaatcatggacgatttgggcgcctgcgaaagcatccatcaggtaaaagggggcaaacatcatttggcgttgcgtgatggggcggtctgcttcgctaccgatgcagaggtcgatgccgaagcgggcccacggatggcctttgcagtattgatgtacgatatcgcggaaagatagcgaaccgtcttgcggctctgcgggatatattacctttccgtcaatgctttcttctattttatcgcgcgggcgtgtagcgcagttgtcataaaagaaattataccggtaaactctgttttcgggaagatagttttcttgcagtagtcggatgagttccgctttttcttctttgctcaggttgagtgtctgttgccagacgctgcgcccgtcgaaggcatattccgccgcgaaacgggcgtagtcggtagctcccagctggtagtctgtctcaccgagtgaaaaacggaggatgaagttgggagtattgaagctgaatagtccatagttgaatacggcatctattccgttggccggatcttcgtagcggatggctgtatgtccgaacagggagtatatttcttcaccgggggcgcaagtcagcaggctgaggcggatggagtcgttgccagaagctatggcttgtccgtttgaaaagataagcagataaagagtcagtaatggatatagaattgtccgtttcatcagaaatgcccgtttattattttggtggcgaatatacgaagaatagttggattgtagaaacggaggcttcgttttatccaaacagaggctttgttttacccaaacagaggcttcgttttacccaaacagagcctctgattagggtaaatagggcctttaaaagcgttctttttttcttataaaatgtggaacgctgaacggaacactttaaaactcttgtaactgattgatatatagggaaatgttgtgtaaggaaaaatgactatgaaacgcaaagcggtaccataataagggataactaataaattatatatttaaaaatatatagttcgattttggcgtttgggggcgatatttgaaatgaaaaaagaagataattccttctgtatgcttcaacttttctttttttactttacctttgcgccgctaaagacgaaaagtattgaacttaattatcgacataggaaatacgacagcgaaagttgccctcttcaatagaagtgagatggtggaggtgttgaccgaatccaatcaatcattggatagcttggaggctctttgctccaaataccggattgagcgggggattgtagctactgtcgtcgatttgaacgaacggatacttgccgaactggctgctttgccgttccccctgttatggctcaatcatgagactccgctgccggtaggtaatctgtacgaaactcccgagacattgggatacgaccggatagctgccgtagtgggggccaacgagcagtttcctcataatgacatcttggtcattgatgcgggcacttgcatcacttatgagtttattgactcgaaaggacaatatcatggcggtaatatttctcccggcatgcagatgcgctataaagcgcttcaccagtttaccggacgcttgccgctgatagactccaacgggcgcaaactgccgatgggaagggatacggaaactgccatccgtgcaggggtgctgaaaggaatggaatatgaaatttcaggttatattgaggctatgaagcataaatatcctgaacttttggtttttttaacgggcggagatgacttttcttttgatagcagcgtaaaaagtgccatctttgcagatagatttttagtgttgaaaggattaaatagaattttaaactataataatggtaggatttaaacacacgatttgggcgcttttgctcatgatggttaccggaacggcaatcgctcaaaataatacaaactctccttacacacgatatggctatggcgacttgtccgatcaaagtttcggaaatagcaaggcgatgggtggaattgctttcggactcagggatggagcacagatcaatccaacgaatcctgcttcctatacggccattgattcgttgacgttcctgttcgaagggggtgtcagtttacagaatatgaatattagtggtggtggcctgaagttgaatgccaaaaacgccagtttcgattatctcgctatgcagttccggttggctccgtggatggcgatgagtgtcggattgttgccatattctaatgtggggtatacggtgtctgatagtcagactacggacaatggtttggcatatagcagaagttttaccggcgacggtggtttgcatcaaatgtacgttggtgctggtgtaaaagtacttaagaatctctctgtcggtgtgaatgcatcttatttttggggagatataacccgtacaagaggaatgttctatccgggaacatcttcttatgattcctatcagcgaaaaatggtaacctcgatttctgattataaattggatttcggtgcacaatatacacaggctttgaataaaaagagttctttgacgattggtgctgtatattctcctaaacataagttgaataatgattatacgtcaattgtaatcatgggagcatctagttcaagttatggaactgaatataaggatgtcttggatgctacatttgaattacccaatacctttggagtcggatttacatataactatgacaagcgtttgacagttggtgcagattatagcttacagcaatggtcaaaaactaattttggcgtagtaacaagtgacgagaatgtacgtcaggactttaatgaaactttcacttattgtgatcgtacaaaaatatcagtaggtgcggaatacattcctaatttgataggacgttcctatttcgcccacataaaataccgtttaggagcttattatacgacgccgtattataagattgatgggaaaaaggcttcacgtgaatatggtgtaactgccggtttcggtctgcctgttccccgttcgcgttcaatacttagtatcagtggacagtttgtccgtgtaaaaggattggagacgaacatggtgaatgaaaatatcttccgcgtgagtatcgggcttacgttcaacgaacgttggttcttcaagcgtagggtagagtaataaaagtgagagagagaatagacgatattatataaacaactaaaatttagatacaatgaaaattaaaacgcttgtggctatgttgttcctttcggctggagcaaccactgtggtggcacaggatgcgtctaactgtaactcaaacagtagtatttcgcatgaggctgtgcgtgcaggaaattttaaagatgcgtatactccctggaaagctgtgttggaaaattgtcccacactccgtttttacacttttactgacggatataaaatccttaaaggcttgatggctcagattaaggataagaataatcctgaatatcagaagtattttgatgaattgatgaatacgcatgatttgcgtatgaaatacacagaagaattccttgcaaaaggaactaaagtgtcttctgctgacgaagcactgggtatcaaggctgtagactatattgctttggctccgaaagtagacgctaaccaagcctatcaatggttgagccagtctgtaaatgcagtgaaaggcgaatcggcagctgctacgcttttttatttccttcagatgtcattggataaactgaaagctgatcctaatcataaagaacaatttattcaggattatctgcttgcttcagaatatgctgacgctgctattgctgcagaaactaatgaagcaaaaaagaaaaactttatgggtatcaaagataacctcgtggctttgttcgtaaacagtggtactgctgactgcgaatctctgcaaagtatctatggcccgaaagtagaagctaaccagacagacttggcttatctgaaaaaagtaatcgatatcatgaaaatgatgagatgtacagaaagcgaagcttatctgcaagcatctttctacgcttataagatagagccaacagctgaagctgctacaggatgtgcttatcaggcattcaagaaaggtgatattgatggtgctgtgaagttctttgacgaagcaatccaattggaaactgacaacgtgaagaaagcagaaaaggcatatgctgctgcagctgtattggcttctgctaagaaattgtctcaagccagatcatactgtcagaaagcaattagcttcaacgagaactatggtgctccttatatcctgattgctaacttgtatgcaatgagtcctaactggagtgacgagtctgcattgaataagtgtacatacttcgctgtaattgataaactgcaacgtgcaaaagcagttgacccaagtgtggctgaagaagcaaacaagttgattggtacatattccggtcatactccacaggctaaagacctatttatgttaggttacaaacaaggcgaccgtatcactatcggtggctggatcggagagactacaacgattagataaaatttatgttgcgaaaacgaagtaaccgtttgttgcataaaagcataagcataacaattgccttcggggcaattgttatgcttctttcattttcttcctgcggcggtaagaagaatacgctgggcgacgccatcacagaacgtgattcattaccggtgatgaatacactgggagtaactactcttatatccgactcgggagtgacacgttatcgggtgaatacagaagaatggacggtgtacgaccgcaagaaaccttcctattgggcatttgaaaagggagtttatctggaacaatttgattctatctttaatattgaagccagcatcaaggcagataccgcttattattatgataagcagaaactctggaaactgatagggaatgtagatatacagaaccggaaaggggagcgtttcaataccgagttgctttattggaacgaggcaactcaaaaagtctattccgacaagtttatacgtatccagcagccggatcgtgtaattaccggacatggttttgactccaatcagcaaatgaccgtttatgtcattcagaatattgagggcattttctatgttgacgaaaatgggggaactgctcaaccggaagtaaaagcattgccgccggattcgacgaaaaaagattctgtgaaataaactatgaatatttatatctctttactcatcactatggctttctccgctttcttctcaggaatggagatcgcgtttgtctcagtagataagttgcgctttgaaatggaacgtaaggggggaatcacatcccgtattctttccatctttttcaagaactcgaacgaatttatctctaccatgctggtaggaaacaatatagcattggttatctatggtatattgatggcacagatcatcggtgataatctgttggctggttttattgataaccactttctgatggtgttggcgcagaccgtcatctctactctgattattttggtgactggagagtttcttcctaaaacattgtttaagatcaatcccaatctggtcttgaatgttgccgctattccgctttttatttgttatgtcattttatatcctgtctcgaagttatcttccggtttgtcttgcctttttcttcgtatattcggtatgaaggtaaataaggatgcttcggacaaggctttcggaaaagtcgatctggactacttcgtgcagagtagcatcgataatgctgcgaatgaagaagaattggatacggaagtgaaaatctttcaaaatgcacttgatttctcaaacataaaaatacgtgactgtatcgttccgcgtaccgaagtcgttgcggttgaccttactacttcgctggatgaactcaagagtcgttttatagaatccgggatctcgaagatcatcgtgtatgacggaaatatcgataatgtggtcggttttatccattcgtcggaaatgtttcgtgatccgaaagactggcgcgataacgtgaaagacgtgccgatcgtacccgaaacgatgtctgcccacaaactgatgaagctgtttatgttgcaaaagaggacgattgccgtggtagtggatgagtttggaggtacatccggcattgtgtcgttggaagatttggtagaagaaatatttggtgatatagaagatgaacatgacaatacttcctatatctgcaagaaaattgacgaagatgaatatgttttgtccgcccgtctggagatagaaaaagtcaatgaaatgttcggacttgatctgcccgaatcggacgactatctgacggtaggcggattgatactgaaccaatatcagagcttcccgaaactgcacgaattggtacgtgtcggccgttatcagtttaaaataatcaaggtgacagcgacaaaaatagaacttgtacgcttaaaagtcatggaataatggcgataaccgtgaaatttttagctaataaatagaagcatattagcattttttgtatcttcgtgcgctaaaatgacaatagaaagaaataataataaacataaatcgtattaatcaaaatggcaacattacaaaacattaggtcgaaaggacctctattggtgattgttatcggtttggcgctgtttgctttcatcgcgggtgacgcgtggaaggtgatgcaaccgcaccaggcacatgacgtaggtgaggtgaacggagatgctctttccgctcaagagtatcagaatctggtagaagaatataccgaagtgataaaactctcccgtggagtgactgcactgaacgacgaacagaccaatcaggtgcgcgacgaagtatggcgttcctacgttaataacaaactggttgagaaagaagcaaaagcattgggactgacagtttctgctgctgaaattcaggatatcctgaaagcaggcgtgcatccgttgttgcaacagactcctttccgcaacccgcagaccggtgctttcgataaggatatgctcaataagttcctggtagattacgctaaaatgaacgaatctcagatgccggctcagtatgcagaacagtacaacaacatgtacaaatactggtcattcatccagaagacattggttcagagccgcctggcagagaaatatcaggcattggtagcaaaagcgcttctctctaacccggtagaagcacaggacgcttttgacgcaagagtgaatcaatatgacttgttgatggctgccgttccttattcttctatagtagattctacaatcgttgtgaaagaatcggaactgaaagacctttataacaagaaaaaagaacagttcaagcaatatcaggaaagccgtgatatcaagtacattgatgttcaggtgactgcaagtgcggaagacagagctgctatccagcaggaagtagacgaagctactgcacagctggctactacaacagatgactatacttcttttatccgttctgtaggctcggaagctccttatgtagacttgttctataataaaacagctttcccgtcagatgtagttgcccgtctggactctgcatccgttggttctgtttatggtccgtactataatggtgccgacaatactatcaattcattcaaagtggttgcaaaaacagctgctgccgactcaatcgagttccgtcagattcaggtgtttgcagaagacgctttgaagacaaaagccttggcggacagtatctatactgctatcaaaggcggtgctaacttcgcagatctggctaagaaatacggtcagacgggtgagactaactggatgagctctgcacagtatgaaggcgcacagatcgatggtgacaacctgaagtttatctctgctatcaataatacaggcgtgaacgaagtagtaaacctgccgttgggacaagctaatgtaatcctgcaagtgactaacaagaaagctgtgaaggataaatataaagtagctgttgtgaaacgtgaagttgaattcagcaaagaaacttataaccgtgcttacaatgatttcagccagttcatcgctgccaatcctactgctgaaaagatgatcgctaacgctgaagaagccggatacaaactgcttgacagaagagacttgtatagctcagaacatactatcggtggtgtaagaggtactaaagaagcattgagatgggcattttccgctaaaccgggtgatgtttccggtttgtatgaatgtggcgaaagcgaccatatggttgcagtagctctggttggtgttactccggaaggatatcgtccgctgaaagctgtacaggatcagttgagagctgaaatcgttaaagataagaaagccgaaaagatcatggctgacatgaaggctgccaatgcaacttctctcgaccagtacaaggctatgtccggcgcagtcagcgattctttgaagctggttacatttgccgctcccgcttatgtttctgcattgcgcagcagcgaaccgttggtaggtgcttatgcttctgtggctgaaatgaataaactgagcgctccgatcaaaggtaatgccggtgtatttgtgcttcagatgtatggcaaagacaaactgagcgatactttcaacgctaaagatgaagaagctacattggctaacatgcacgcacgcttcgcaagccgtctgatgaacgacctgtatctgaaaggaaaagtgaaggatacacgttacctgttcttctaagattagtcgtaaaaacgataactgcaaaaggtcgttccatgctttggaacgaccttttttgctaacttttacatccttgctatacggaaatcgactttatttccttacatttgcaaatataaaccatgaacagaaagaatgatgtctaaatatcccctcttaggaatgacgcttatagagctgcagtcactggtgaaacgtctgggaatgccgggctttgcagccaaacagattgcatcctggctttatgataagaaggtgacttcgattgatgaaatgactaacttgtcgttgaaataccgggagttactgaagcagaactatgaggtaggagctgaagctccggtggaggaaatgcgctctgtagacggtacggtgaaatacctgtaccctgtgggcgagaatcattttgtggagtcggtgtatattccggatgatgaacgggcgactttatgcatctcttcgcaggtaggctgcaaaatgaactgcaagttctgtatgaccgggaaacaaggctactctgccaacctgaccgcccatcagattatcaatcagattcactccttgcccgaacgggacaaactgacgaatgtcgtcatgatgggaatgggcgaaccgctcgataatctggaagaggtgttgaaggcattggacatactgactgggtcctatggttatgcatggagtccgaagcggattaccgtttcaactgtcggattgcggaaaggattgcggcgctttatcgaagaaagcgactgtcaccttgccatcagcctgcattctccggtgaccgcccagcgtgcggaactgatgccggcggagaaagccttttctatcacggaaatggtggaactgttaaaaaactatgattttagcaaacagcgtcgactttcgtttgagtatattgtttttaaggggcttaatgattcgcaagtttatgccaaggagttactcaaactgcttcgcggactggattgccggatgaacctgatccgtttccattctattccgggagtagcccttgaaggagccgatatggatacaatgacccgtttccgtgactatctgaccacgcacgggcttttcactaccattcgtgcttcgcggggagaggatatttttgcggcatgcggtatgctgtcgactgcgaaacaggaggaaaataataaaagttaatataaaaatcgaacatcatgaaaaagtactttttttatttaagcatggctctggtagccttcgtagttgcttcttgtggattaaaggggaatcatacctctagcggtcgtccgtatgaactgttggttgtagtagatgcgggagtgtgggaccgtgccgccggaagggccttgcatgatgtgcttgattctgacatgccgggactgccccagtcggaaccttctttccggattatgtatacttcaccgaaggactatgattctacgctgaagttgatccgtaatattgtgatagtagatataaaagatatttataccaaaggtactttcaagtatgcgaaagacgtttatgcttctccacagatgatactgaccattcaggctccgaacgaagaagtgtttgagaagtttgtcgaagaaaacaagcagacgattatcgacttcttcactcgcgctgaaatgaaccgtcagattactttgctggaggaaaagcacaacaactttatctcaaataaggtagatagtctgtttggctgcgatatctggataccttccgaactgaataactccaagacaggagaggacttcttctgggcatctaccaatacaggcagcgcggatcgcaatttcgtgatgtattcttatccttatactgacaaggatacattcaccaaagaatactttgttcataagcgcgattctgtgatgaaagccaatatccccggatataaagaaggcgtatatatgtcgacagactcgttactgaccgatgttcgtccgatcaacgtgcacaatgactacacgatggaagctcgtggattgtggcgcatgaagggtgacttcatgggtggcccgttcgtttcccatactcgtctggatcagaagaaccaacgtattattacagcagaaatatttgtatattcacccgataaaatgaaacgcaatctggttcgccagatggaagcatctctttatacgctgaaacttccgcaagaaggtcagcagagtcagattccactgggggtaaccagagaagcggaaccaactaataaataaaaacatggaagaaaacaaaataagaatcggcattacccaaggagatatcaacggggtaggttatgaagtgatcttgaagacattctcagaccctaccatgcttgagctatgtactccgattatctacggttcacctaaagtagcggcttaccatcgtaaagcactggatgtacaggctaatttcagcattgtcaacacagcttccgaagccggatacaaccgtctgagtgtagtgaactgtacagatgacgaagtgaaagtggaattctccaaacccgatcccgaagcaggtaaggctgcattgggtgctttggagcgtgccatagaagagtatcgtgaggggctgatcgacgtcattgtgacagctccgatcaacaaacataccattcagtcggaagagttctctttccccgggcatacggagtatattgaagaacgtctgggcaatggaaacaagtcactgatgatcctgatgaaaaacgattttcgtgtggctttagtaacgacgcatattccggtaagggagattgctacaacaatcaccaaggaactgattcaggaaaagctgatgattttccatcgttgtctgaaacaggatttcggtatcggtgcgccccgtattgcagtgctttcactgaatcctcatgcaggagacggcggactgctgggtatggaagaacaggaaatcattatccctgccatgaaagaaatggaagagaaagggatcatctgttacggtccttatgctgcggacggttttatgggttcgggcaattatactcactttgacggaatccttgctatgtatcatgatcagggactggctccgttcaaagccctggctatggaagacggtgtgaactataccgccggactgccggttgtacgtacctctccggctcatggaacagcctatgacatcgccggtaaaggactggccagcgaagactctttccgccaggctatttatgtagcgattgatgtattccgcaaccgccagcgcgagaaagcggcacgggtaaacccgttgcggaagcagtattacgagaaacgggacgatagtgataaactaaaactggatacagtagacgaagattaagtaataggtattaagtaataagtattaagtattagccatgcggatggaagcgagatgataatgatggtaatacttaatacttattacttaatacttattacctattacttaatattaagatagatgaccaaagcggagatacaacaagtgaaacagcgtttcggtattattggcaataccgaggctttatcacgtgccatagatgttgccattcaggtagcgcctaccgatttgtctgtgctgattaccggagaaagtggtgtcggaaaagaaagttttccacagatcattcatcaatatagccggagaaagcacggacagtatattgctgtcaactgcggtgccataccggaaggtacgatcgattccgaactgttcggacacgagaaaggagcatttaccggtgctattggtgagcggaaaggatattttggagaagctgacggtggaaccatcttccttgatgaagtgggagagttgccgttgcctacacaggcgcgtctgcttcgtgtacttgaaagcggtgaatttatcaaggtaggttcatccaaagttcaaaagacggatgtgcgtattgtggcagctaccaacgtgaacctgacacaagccattgccgaaggacgttttcgggaagatttgtattatcggttgaacacggtgcctattcagataccacctttgcgtgagcgcggagatgatgtgctgttgttgttccgtaagtttgccgcagactttgccgaaaagtaccggatgccggctatccagctgacggaagatgccaagaagatattgcttgcttatccgtggccgggaaacgtccggcagttgaagaatatcacagagcagatttcgattatagaaacaaaccgtgagataacggctgcgattctgcagacctatcttccggcacagaatacccaacgccttccggcactgttcggcacacgcgagagcaagagctttgagagcgaacgcgaaatactatattctgtcttgttcgatatgcgccaggaagtggcggaactgaagaagatggtgcacaatatgatggccgaacgtgcgggacaagtcggacagatgggacaggtagtggctactccggtagtgacgacgacgcaccaaccatctgtgccggccattatccatgctgtgcagcaaccgtctgtttgtcccaaagaagacgatgacgatattcaggacacggaagaatatgtggaagaaaccctttcgctcgatgaagtggaaaaagaaatgatacgtaaagcgcttgagaggcatcatggtaagcggaaaagtgcggcaaaggatctgaatatctccgagcgtaccctttacagaaaaataaaagaatatgaattggattaagaaaatagcacgaccgctgatactgattgttttaccggcagtcatcatcgcctgtagtgtgtcctataagtttaatggctcctctatcaattacgataaggtgaagaccatttcgattgctgatttcccgattaagtcggagtatgtgtatgctccgctggctaccaagttcaatgaagacctgaaagatatcttcatcagacagacccgtctgcaactgctgaaaccgaaccagaatgcggatctgcagattgacggtgaaattacgggctacaaccagtataaccaggcagtgtctgccgatggttactcttcggaaacgaagctgaccatcacggtcaatgtacgctttgtcaacaacacaaatcacgccgaagacttcgaacaacaattctcagctttccgtacctatgattccagccagctgctgacggccgtacaggatggattaatagcggaaatgagtaaagagataaccgaccaaatatttaatgcaactgtagcaaactggtaatttaatgacttctgttaacttgcaacaatggattcagcatcccgagacgctgaatagggatactttgtacgaactgcgcaaccagctcgcgaggtatccgtattttcagtcgctccggttgttgtatctcaagaacctgtatattctccacgacattaatttcggtgcggaactgcggaaagccgttctgtatattgccgaccgacggaaactgtttcatctgatcgaaggcgaacgcttcgctgtcgaatcccagaagaaaggactgcctctctctgaagtattgaaagatgagcctaccgtcgaccggacactggctctgatcgatgctttcctttcgacggctcccgaagaagtaaccagtcagacaagctttgattactccatggactatacggcataccttctcgaagagacacctgtcgtcgatgagccggcagaggcaatgcccaagttgaaaggacacgagctgattgacaactttatcgaaaaaagcgagactgatccagtcgtatacctgaaacctttgaaggaagaagagaaagcaaaggcagcttcttccgctgaaacaaacgaaacgggcagaacagacgaaacaactgaaaccaacaccgtagaagaggaagatgacagctgtttcacagaaactttggccaaaatctacgtaaaacagcaacgatattcgaaagctcttgaaataattaaaaaattaagcttgaaatatccaaaaaaaaatgcttactttgcagaccaaatcagatttttggagaaattgattattaacgctaattcaaaataactaaaaatgtacttattattcattatcttaatggtgattgcagccttgctgatgtgcttcatcgtgctgattcagaattcaaaaggaggcggacttgcttctggtttttcttcatcaaacgctatcatgggcgtgcgcaagactacagattttctggaaaaagcaacttggggtctggctatcttcatggttgtgatgagcgttgctactgcttacgttgttccttcttcttctgcagctaaagatgtattgttggaacaagcacagaaagaacaacaaaccaatccgtataatatgcctaccggtactgctgctcctcagacagacgctactgctcctgcagagtctgcaccagcaacagaagctccggctactgaaactcctgctcctgcagcagaataattcagtgacaggatattcggtttaaacttattgagtgaacgggctttttgacccgttctcttcattataggcgcgaattacgcgaattacaagagattctaatagaattgtgtaatacgtgtggttcgcgcctatctttattattgggtccggtctgctcttcttcatacaggaatatccggtcagatgtcctttttcttataaaatgttctccttttttagtaaaacaaatgataattagttaactttgttgcccgttacgagattattaactccttttaaatattacaatgacagaacaattgaaacaaaagctgaatgactccgcagtgctgcgttggagtgttctagcattagtcgcttttaccatgttgtgcggctacttcctcacagacgttatgtctcctctgaaacccatgcttgaaaaagaacttctctgggacagtttagattacggttttttcaccagtgcttatggctggtttaatgtattcctgctgatgctcatctttggtggtatcattctggataagatgggagtacgcttcaccggaatgggtgcctgtttattgatggtgtttggttgtggattgaaatattatgctattactactactttcccggaaggtgcgatgcttttcggattcaagatgcaagtcacattggctgcattgggctatgctattttcggtgtaggagtcgaaattgcgggtatcaccgtttcgaagattatcgtgaagtggtttaaaggcaaagagatggctctcgctatgggactggaaatggcgaccgcgcgtattggaacaactttggccatggtgcttaccgttcctttggcagacttcttcgggtctacggatgagagcggcgtattccataccaatattcccgctccgattctgttctgtctcgtcatgctgtgcgtaggtaccatcgcattcttcatctatactttctatgataagaaactggatgcttcactggatgcggaaggactggaaccggaagaacctttccgcatgaaagacatcgtatatatcattaccaacaaaggattctggctgatcgcattactgtgcgtattgttctattcggctgtattccccttcatcaagtatgcggctgatttgatggtacagaagtacaatgtagatccgaaacttgcgggaacgattcccggattgctgccgattggcgcgatcatcctgacaccgttgttcgggtcattgtatgaccgtatcggtaagggagccacgctgatggtgatcgggtcggtgatgctgattttcgtacacactatgttcgctcttcctattctgaatatctggtggtttgcaacggtgatcatgattattctgggatttgctttctcattggttccttcggcaatgtggccttcggttccgaagattattccggagaaacagttgggaacggcttatgcgttgatcttttgggtacagaactggggattgatgggcgtgcctttgctgattggatgggtgttgaattcttattgcaaaggtccggttgtagatggtgcacagacttatgattataccttgccgatggctatttttgctatgttcggtgtacttgccctgattgttgccttgatgctgaaagcagaaaacaagaagaaaggctacggactggaagaagcaaatattcagaaataatccagtatatattctatctgaaaagatataaaagagaaaagatatggctacgaaagagaaaataaacctcctggaggtgatcccttgtcgtaacgaacatattaaagctgaacaggaaggggagactattgtgctctccttccctcgttttaaacgttcgtggatgagtcgttatttattgccgaaaggaatgtccaaagatattcatgtgcgtctggaagaacacggtacggccgtatggaacctgatagacggccagcggacggttcgtgagattatagaaaaactcgcagaccactttcagcatgaagcaggctacgagtctcgtgtatctacctatctttcccaattacagaaagacggatttattaaatggataattgattaatggataattgataatggaaaatggataatgaggttgagcagctggaatattatcccatacgttcattatccattatcaattttccattatccattaaaaaaagattgcccacaggaggacagcacatcctatcagtacgcccataatgatgagcgttccccatacgaaatagctgttatctttttcttttttcttttccgaatccttgatgatgcgttccatctcttccggagtcgtatccggcagaagataagggtcgttgtttcttctaagtcgccctaacttgtcatttctccgttcacggcgtaagcgggaggcttctttgccgtctttcagccgacgtatcatgtcgagcatatgtccttcgccacccatcgttttgtttttttagaggttttatttgctttcttctctatctactttcagtagtccaccggtcaccggatcaaagtaaactttgatggtcgagttcttgttgaataataccggagcaaggtattctatgataccgaactgagtaacaggtatttctccttcatacaatttctttttgccgtccgtcagcgtcaccattgcctgtcccggtacgttataagcaatgccttccatctctttcttcttttttccgtcctcttgcggaatcttcaccgttttcaggtctttcagactgatgtagaatggagtgcctgccaaatcgttgttggcaactatacccagcttctttgaaaagcggaaagctacctcattgtcgaattccttatccggagtgaggcggacagtaaatgtcttttcttctttattgcggactcccgaaaacatctcggtcatggcttcttcctgaagattcaggttgtcgagcatgattttgagctgtgcgccgtccgaaggcatattatctgcttgtccgcgcaataatgcgtttttactttcgcggatattatagatttcctttgctaccagttcggccatcttggcggttgaacttgccatcagaatttcttctgtgagaaagtcgcggggattggcttttcgttggggagcaacggcattgtttgctgcattctttgcattgttgctgctgtaggggacgttgattgatttgataagaccctcttcagtcagttccataagaggagctacggttttgtctttcagtttgacgaaataagtagcttcgctgtttggtacacctacaggtttcactttgacactgttcagttcccagtattcttcgggttcggcagagacgttggtcagtctcaggtagcggtcggcgtatttgctgaattcacccggcttatagttgactttgtttgcttttatttctatttctatctgggttttggggagggcgtacactactccgtagtcttttcctcgcgtcactcctgtcagcacttcggtctgcgcataggcggaagttgccattagtagtcctgttgctatgattaactttttcatattcggttctttttagctgattttgaaaaacaaagttaatgaagttattgaataaaccgtaagttcttaacttttattcgcttacaagtcgccatgccgtcggcagacaggtcacgatatcacttgcgattaatccgatcatgccctgttttttctgggcgatgtctccggccaatccgtgaatgtaagtaccgatctttgcggcgtcttcggcgggatagccttgcgcaaggagtgcaaggattactcctgtcagtacatctccgctgcctcctgttgccataccgggattaccggtctggttgaagtaacatttgccttcgggggtgataatggcggaataagctcccttcagaatgatatgtactttggcagtgtgcgccagttcgcaggctttcatcagtcgttcgtatgagtcctgacatttgccgaccaggcgttccagctctttcgggtgaggggtgaggatggaacctttcggcagatgggtgagcgtatgccggtgattggccagaatattgagtgcgtcggcatccagtaccgtcggagtctgacaatgttccagttgttctatcagggcggcttccgtttcctcgttgcgaccgagtcccggaccgatgccgacagcttggtaatcgtccgtatcggtaggtacggcaaagcatgtttcgctgacatctgcttctaccatggcttcgggggcggacgtttgcagaatatcgttgttgcataacggcgcgtgtacggtcagcagacctactcccgagcgcagacaggcacgcgcggccagtaccgatgcacctgccattccttttgagccggctatcagcagggcatgtccgaagtttcctttatgggcgaattgttggcgtggtttgatcagtgaacggatttcttcgatttccagcatttcgtagtttgtttcagtctcttcgattccttcttcgctcagctggatgtccaataactcccattcgccaacaaattctgtattttcggcaaagaggaaggccagtttaggaagttgcaggctgaaagtgacgtccgcacggataatattgctttttacattgaatgtattttcttctcccatcagtccggaagggatgtcgatggagactaccatggcgggagaggcattgatatatttcacaacggcagcgaatcctccgctcaatggtttgttgagtccggaaccgaataatccgtcgatcacgagatgttccggtgtcagtgtgggaggtacgaactgggtgctgatttcatggaaagttacttcttccatcatctctaccagttctttgttggtctggcagtcgggcgaaagttcgcctttcgtgttgaagagatatacttcgatcttgtatcctttttccgccatcatgcgggcgatggcgagggcgtctccgccattattgcccggtccggcaaagatggtgacaggtgtttccggattccatctgttggtgatggctttagtcagcgcctgtgcggcacgctccattaaatctatggatgcaatcggttcatgttcaatggtataggcatctaacttcttaatgctgctgcttggaaatattttcattgcgatattcttttagttttcgacgcacaaacttacacaaaaactctgaattaatcctttattccggttggttttcggctttagataaagtggcaaattgaaaaatgcaggggaaatcagaagttatcttggggtggctttgtcctgtctgtctgtgattcctcagttggggggcggatatttctctgcaaaggtacgggcattcttcagataagatgcggagacttttcggctaagatgcaggcattcttctcttaaagtgcctttttctttagttgctcacggccgtgacaagacttcgccacgaccgtgagcaatgctaatcacggtcgtgaacaatgcttgtcacgaccgtggtcagttaatgatatcggtgctttgatgtaactattctactgctttctccttaatcttccgatactttgagagatagttacgccttctccggcctgctatagaactgcttcctttatgagtgtcttcggcgtttggaataaagctgtcagtagatatggtacaatataaacagctaatgccttgattatttgcttttttcgaaaaaaatgatatctttgtagtgcagtaatgtgctttacgttattctcctgtgctcacaatgtttagattataaatataaattgtttaatcttctaaagtttgcatgatggaaaagaaaagaattggctcaaatgccgggaaagtatggcgcatcttaaatgaaaagggcgaacagtctatgttcaccttgtgccatgagttaggtttgacgttcgaggatgtagcgattgctatcggctggttggcaagggaaaataaaatcctgcttagaaaaaaagaaggaatgctctatgccagtattgagaatgttgaatttacttttggataaatggcgactgacccacatttaaggggaatatccacttgattatttacactgttgaaaacataataaggtgggtaactgagacttcttgcacgccatcctgtatttttctattccataagaatcttcttttttgaggcatttaatctactttttagtacctttgcaccccataaactactaaacacataattcatgagttcattgaaagggcacccgaaaggcctttacctaattttcgcaacgagcacggcagaacgtttcagttactacggtatgcgtgccatctttatcctctttctgacgcaggcattgctttttgataaagaagcggcagcctctatctacggtagctacaccggactggtctatctgactccgttgatcggcggatacattgccgataaatattggggcatccgtcgttcggtattttggggagcggtgatgatggcagtcggtcagttcctgatgtttatgagtgcctcttcactgaacaatacagaccttgcccactggctgatgtatggcggactcggattcatgattttaggtaacggttgctttaagcctaccgtttcttcgctcgtcgggcaattatatgaacccggggacaaacggttggatgctgcatacaccattttctatatgggtgttaatgtaggttctttcgctgctcctttgatttgcggtttcttgggagacacagggaatccgcaggactttaaatggggattcctcgcatccggaatcatgacgctgttcactgttgtcctctttgaaactcagaagaataaataccttttctctccttccggtgaaccaattggtatcgtccccgacgccagacgtgaaaaaaaggaggataaagccgaacatatttcacatccgaagatggacaaacgtaccaaagtacgtaatatcatcatcattactgcccttacagttgccttaatagctttttttagctatgcctttagcgatgactggattagtgtgggtatctttacggcttgtattgtctttccagtactcattctgctggatggttcattgaccaaagtagaacgtagccgtattttcgtaatctatatcgtagctttcttcgtcattttcttctgggcagcttacgagcaggcaggagcttctctgacattattcgcttccgaacagactgaccgcagcattttcggctgggagatgccggcttcgtggttccagtcattcaatccgctttttgtagtgatccttgcctatattatgcccggtatatggggctttctgaataagcgaaacatggaaccggcttcccctaccaaacaggcaatcggtctgttgctgctttctcttggttatctcttcatctgttttggagtgaaagatgctattccaggagtaaaggtgagcatgatctggctgacaggactttattttattcatacaatgggagaaatcgctctgtcacctatcgggctttctatggttaataagttgagtccgttacgtttcgcctccttgatgatggggatctggtatctttctaccgccaccgcaaataaatttgcaggtatgctgagtggcctctatcccgaagacggaaaagtgaaatcaatccttggttatcagatcgctaccatgtatgacttcttcatgctgttcgtcattatgtccggtgttgcctcactgattctgttccttctctcgaagaaattacagaagatgatgcacggggtagaataaaaaattgtatttttgcgacaacttttttaaaatgaccggttatggataccatacagataaaagacaagcaatttactgtttccattaaggaacaggatattcaaaaagaagtgattcgcgtagcgaacgaaatcaatcgtgatttggcaggtaagaatccgctcttcctcagtgtgttgaacggctcgttcatgtttaccgccgacttgctgaagcatattacgattccgtgcgaaatttcattcgtgaagttggcatcttatcagggggtgacttccaccggagtaattaaagaagtgatcgggctgaatgaagacattgccggacgtacggtagtgatcgtagaagatattgtagataccggactgacgatgcagcgtctgctggatacactgggcacacgcaaccccgaagcgattcatatcgcctctttgctggtgaaaccggaaaagctgaaggtcaatctgaacatagaatatgtagcgatggaaataccgaatgattttatcgttggctacggattggattatgatggtttcggacgcaattatcccgatatttatactgtagtagattaaattcaaatacaaattaatttttaggttaaaaagatgttgaacattgtaattttcggtgctccgggttcaggaaaaggaacgcagagcgaacgtattgtagaaaagtatggaatcaaccacatctcgacaggagatgtattgcgtgcagaaatcaagaacggcacggaactgggcaaaactgctaaaggttacatcgaccaggggcagttgattccggatgaattgatgattgatattctggcaagtgtattcgatagcttcaaagacagcaaaggtgtaattttcgacggtttcccaagaacaattgcacaggcggaagcattaaagaagatgttggcggaaagaggacaggatgtttctgtaatgttggatctcgaagttccggaagatgaactgatggtacgtctgatcaaacgtggcaaagactccggtcgtgccgacgacaacgaagaaacaatcaaaaaacgtctgcatgtatatcattcacagacatctccgctgatcgactggtacaagaacgaaaagaaataccagcacatcaacggtctgggtactatggatggtatcttcgctgatatctgcgaagcagtagacaaattataataaataaaaaatatggctgaatcgaattttgttgattacgtaaagatatactgtcgctcaggcaagggcggaagaggctctacgcacatgaggcgcgagaaatattgtcctaacggaggtcccgatgggggcgatggtggaagaggaggccatattatcttgcgcggtaaccgtaattactggacattgcttcacttgaagtatgaccgtcatgcgatggcaggtcatggcgaatcgggcagcaagaaccgtagtttcggaaaagacggtgcggataaagtgatcgaagtaccctgcggaacggtagtgtataacgccgaaaccggagaatacctttgcgatgtgacggacgacggacaggaagtgatcttgctgaaaggcggtcgtggcggtcagggtaacagtcatttcaagacggctacccgtcaggctccgcgctttgcgcagccgggcgaaccgatgcaggaaatgacggtgatcatggagctgaaactgttggcagatgtagggctggtaggtttcccgaatgcgggaaagtctacgttgctttctgctatttcggctgcgaaaccgaagattgccgattacccgtttacgacactcgaaccgaatctgggaattgtttcctatcgcgatggaaagtcattcgtgatggcggacataccgggcatcatcgagggagccagtcagggaaaaggattgggactgcggtttctgcgtcatatcgagcgtaactcgttgctgttgttcatggttccggcagatagcgatgatatccgcaaggagtatgaagtattgctgaatgagttgcgtacgttcaatcccgaaatgctggacaaacaacgtgtgctggctatcacgaagagcgatatgctcgatcaggagctgatggacgagattgaaccgacattgcccgagggtgttccgcatatattcatttcttctgtttctggtttgggaatctcagtgttgaaagacattctgtgggaggaactgaacaaggaaagtaataagatagaagacattgttcaccgtccgaaagacgtgacccgtctgcagcaggaactcaaggacatgggcgaggatgaagaactcgactatgaatatgaggaagacgctgacgacgacgatgatgatctcgactacgaatacgaagaagaggattgggaagaaaaatgatttcaatcacaagagataaaagaatgttggggtatgagtcgttaagctcatactccaacatttctcattttgtaactacccggcagggagggtgcagcgaaggaaattatgcgtcattcaactgtacgccctacagtggagacgaggcggaaaaggtctggcggaatcaaacgcttctgatggaaggaatgtcgcagacacccgaagaactggtgattcctgtgcagactcatgagacgaattgcctgctgatcggggatgcttatttatcggcttcgtctcaacaacgacaggagatgctgcacggagtggatgctttgattacccgcgagccgggatattgtctttgtatttctactgcggattgtgttcctgtgttgatatatgataagaaacatagtgccatagctgccattcatgccggatggagagggacggtagcatacatcgtgcgtgatactttgttgcggatggagaaggagtttggcacaagtggagaagatgtgatagcctgtatcggtccgagtatctcattggcttcttttgaagtgggtgaggaagtgtacgaagcatttcagaagaatggttttgatatgcctcgtatttctatcaggaaagaggaaaccggaaaacatcatatcgacttgtgggaagcgaaccggatgcaaatccttgctttcggtgtgccgtccggacaagtggagcttgcccggatatgtacgtatattcatcacgacgagtttttctcggcaaggcgtttgggcattaagtccggacggattctgtcggggatcatgattcataaataatagctttgaacatagattgacataaataagcgcataggttggaatagacttgaacgtaagttgatataaacttgaataaaagtatgtttgaaataaaagtatctcaggaaataaagaacgcctgcccggtttttgccggagcagccgtatatgcagcagtgaagaatactgcttactgcgatggactttggaaagaaataaatactttcacagaagacttgactactaccacccaaatggcagacattaagttgcaacctgtgattgctgctacccgtgaggcttataagcgttgtggcaaagatccggggcgttatcgtccgtcggcagaagcgctgcgccgtcgcctgatgcgtggcatccctttgtatcagattgatactttggttgaccttatcaatctggtttctctccgtaccggacattctatcggtggcttcgatgcggataagatacagggtaaacatcttgaacttggcattggcaaagcggaagaacctttcgaaggtatcggtcggggcattttgaacattgaaggattgccggtgtacagagattcttttggaggaatcgggacaccgacaagcgaccacgaacgtacgaagatggatgtcgggactactcatattctcgcgatagtcaacgggtataacggaaaagagggattaaaggaagctgctgaaatgattcaatccttactgagggattatgccggatcggatggcggcgagcttatctattttgaataataaaggaatacatgaagaacatacttattttattgacagtcctgcttttaccaactcttgcttatgcgcaaagtaaatcctctttttcttctatggaggtgaatcatgtacgggttgctactcccggactttttgcgaaaagcaatcatatatatctgcatttggattctttgcaagagcatgaatatgcttttcccttaccgggagccaaagttatttccgcttacggaactcgcggaggacattcgggagcagatataaagacgtgtgccaaagatacgattcgtgctgcttttgatggagtcgtacgtatgtcgaagccatattatgcttacggaaatttggttgtagtccgtcatgcgaacgggctggaaacgatttacagtcataacttcaagaatttggtacagagcggagatacggtgaaagccggacaacctatcggactgaccggacgtaccggccgtgctactacggagcatgtgcattttgaaacccgcattaacggtcagcattttaatccgaatcttattttcaatctgaaggagggcacattacgaaaggaatgtattaaatgtacgaagaatggaaatggggtagtggtgaagccacaggcgaataataatcgtgtggcacaaaataaaaagtgaaagaactgagatggtctgaaaaagacggaaggggattgactaaaaagacaatagtatctccccttcccttcgggaaggaggggtggctgaaagccggggtggtaggtaaaatagggttgtctataatttgcagtgaataagtggactgcgtattcacctaccacctccccctgcgggtactcctccttcccgaagctaccctttatacacaagtcttagctgattaactcatacagttcaaactgtgtataaaatctatccagtccattcttaaaggttatcgtaaacttgggtaagattttatagatattgtttggagaggacttagaattcaccctccccataactgtaatatttcctttgatggtgaaacgcttataatgtaactcctgttttaaagatggcaatttcacgataacctttcttctcgttattaacgaactcaccgcttgctactttaatcacatactcgataaagcgttcgcaagtcttttccatcggttcgttctcaacgatgactccggcattgaaatcaatccatcccggtttgtttttagccaaagtagaattggtggaaatcttcatcgtcggaacgaaagtgccgaaaggagtaccacgtccggtggtaaagagtaccatatggcatccgcttgcggcaagggtagtagcagctactaggtcattgcccggggcggaaagcaggttcagtcctttcttttgcagacgttctccgtaaggcatcacgccggatacatagcttttaccacatttctgtgtacatcccagtgctttttcttccagagtggagatgccgccggctttatttcccggagatggattttcacccacaggctcgccatgggacaggaaatattctttgaagtcattgatcaagtgtacggtctgttcgaacaggtctttgttctcgcaacggttcatcagaattgtttccgcaccaaacatttccggaacttcagtcagcacgcttgtaccgccttgtgcaatcaggaagtctgagaacatgcccagcaacggattggcagtgatacctgagaaaccgtcggaaccaccacatttcagtccgacacgaagttctgacaaaggtacttccgtacgttcatctttggatgctttggcatataaatcgcgcagaatatccattccttcttcgtattcgtcaccaactttctgggttaccatgaatttcacacggtcctggtcatagtctcctaagaattcacggaatacgtccggctggttgttttcgcagcccaagcctactatcagtactgcgcctgcattcgggtgaagtaccatatcgcgaagaatctttttcgtgttttcgtgatcgtctccaagctgtgagcaaccgtagttgtgcgggaaagccacgatggcatctaccccttttccttccgtttcacggcgcaggccttcggccagttgtccgatgataccgttaacgcaacctacagtcgggataatccagatttcatttcttacgccgacatcaccatttttacggcggtagcctttaaaagtgaggtttttatgagggatatccagagtaacctgagtcggatggtaggtatactccaacagtccggcgagattagtcttgatattcgtttcattcatccagtctccctgtttttttgccatacgggcatgaccgatagggtagccgtacttgattacgttctcgccttctgcaaaatcttttaatgcaaacttatgtccagcaggaatgtcttcgtttagtgtaatctctattccatctacggatagatgctctcctgccgggaggttaacaatggcaacggcaacgttgtcggcaggattaattcttaaatactttgtttccatgtacttgtttagttggattttgttgttatttgctatggtaatagtctattgtttctacagtcaacaagtcaatcggcatatagttgatgcaagtcacgtctttcttgaaaatgaggtgatcgcagagcgccttgatgccgttgaggccttgcagttccggttgctgggcgatgaggaaggaaacgcttccttctttcaggcaagtgacattccgttccagaaggtcgtagcctatcagattgaaatttttctttccgcgactttgcaggtattcgccgataatgtagacttttgaattgaaagtgattccattctttacgttcgggtgagaacggaagaattcatccagcatttcgttatcttcatcattgcgttcggcatgcaagtcaagctccagtatagtacaagacggatgatgttcctccatgtactgcctgaatccgatttccctgttctcttgctggttagaaccgacaattccttcatgtatcttacggaaaataacgatttccttttcgtctctggcaagcagcattagcatacgggcggcaaagtatccgctttggcgtgagttctgaccgaagaaggcgaggggaggtacgtctttgatatttgagtctatatatatataaggtatatccaacgtttgcaactgatcagtaaagcctttcgtatattgcggagccgtaggggccaccatcactccgtccggttgctgagtcaggatagcttcgctggcgtctacaaacgaatgatagtcgtatggatcgtaatagttgatctttaccgaggtattgaagtccgagtaggtcgcgatagcttcgtggatacccagttctactgctgtccagtattcgccttccagatgttgaggcagaagacagatgaatgtgtacttcttgttggaagccagggcactggcatacatgttaggttgatagtcaagctgcttcagaatttcttccacccgttttttgcttgcttctgatactccgctgcgtccgtgaatgacgcggtctactgttcctacagacacgtctgctaaacgggcgatgtctttgattctgattctttcgggcaatttattcatacgatcaccttatttatataggtttatgtgctcgcacacaataataatcttaatattttcgatacaaatatataacaatttttgtaattacgaaaattgttgtatctttgtgcccgcacacgaaaggtgtgtggtataactctgtttatgtattaatagtcatgtaatcagtagtttaactcataaaatggggtaaaaatgataaattgaaacttcataatattaataacttagaatttaaaacataagattatgggaaagaaagtcgttacattaggcgaaatcatgcttagattgtcaactccaggtaatacccgctttgttcagtctgactcttttgatgtagtatatggtggtggagaagcgaacgttgcagtaagctgtgccaactacggacatgaagcctatttcgtaaccaaattgccgaaacatgaaatcggacagtctgctgtaaacgcattgcgtaaatatggtgtaaagacagactttattgctcgtggtggcgaccgcgtaggtatctactatctggaaacaggcgcttctatgcgtcccagcaaggttatctatgaccgtgctcattctgctatcgctgaagctgatgctgccgacttcgattttgatgctattatggaaggtgctgactggttccactggtccggtatcactccggctatttctgacaaagctgccgaactgactcgtctggcttgcgaagcagctaagcgtcatggcgtaactgtatcggttgacttgaatttccgtaagaaactgtggacaaaggaaaaagcacagtctatcatgaaaccgttgatgaagtatgtggatgtatgtatcggtaacgaagaggatgcggaactgtgtctgggcttcaaaccggatgctgacgttgaagcaggccacacagatgctgaaggctataaaggtatcttccagcagatgatgaaagaattcggattcaagtatgtggtttctacattgcgcgaatctttctctgctactcacaatggttggaaagctatgatatacaatggcgaagaattctatacttccaaacgttatgatatcgatccgattatcgaccgtgtaggtggtggtgactctttctccggcggtattatccacggtttgatgactaagcctaaccagggtgcagctcttgaattcgctgttgctgcatctgctttgaaacacacaatcaatggtgactttaaccttgtttctgtagaagaagtggaagcattggctggtggtgacgcaagcggtcgcgtacagcgatagttgagagttgagaatggagagttgagagtttgaaaaatcaattcatttaaaataagaaattaaaatggcaaaattcgataaaatagccgtattgaataaaatcggctctacaggtatggttcctgtattctatcacaaagatgcggaagtggcaaagaaagtagtaaaggcttgttatgacggtggtgttcgtgctttcgaattcaccaaccgtggtgactttgcacaggaagtatttgctgaaatcgtgaaatatgcagcaaaagaatgtcctgaaatggctatcggtatcggttcaatcgttgatccggctactgctgctatgtatcttcagttaggagctaactttgtggtaggtccgttatttaatccggaaatcgctaagatatgtaaccgtcgtctggtagcttatactccgggttgtggttctgtatctgaagtaggttttgcgcaggaagtaggttgtgatctttgcaaagtgtttccgggtgatgtatatggaactaactttgtgaaaggtttgatggctccgatgccatggtctaagctgatggtgactggtggggtagagccttccaaggaaaacctgactgcatggattaaagcaggtgtattctgtgtcggtatgggatcaaaactgttcccgaaagacaaggtagcagcagaagactgggcttatgtaactgcaaaatgcgaagaagctcttagctatattgccgaggctcgcaaaaaataagattagagagcgaaagctatctataaataaaaaagaggctgatgcgtcagcctcttcaaaatatgcctcaaagggttagttagtttagttagtaatgaggcatattttccattttgtttaaaggtgtttaaaggggataagtcatcggaatgagtgatcattttggtgacttgttttttttgttggtcgtaagcgcttcttttaagaatgatgtggcattcgcattttgataatccgtccgataacgagcgctgcaatgtacaccacggcaaagcctacgattgaaaatacaaacggtttctgttcattgaaagtgcggcgtggaggtacagcggtataagcctcgttggctgtagtctgattgtcagacttggtggctgctgttacttgcagtgttgtttctgttgctaccatctggcagctatctgtagttgtggttacagtatccactaatatttctgtagacatctttcttacccttttaagttatacgtaaattcctgttatggtttcaacacagtacttatggtttagttcaaagggattcttaaaatcggcgcaaaggtaactaaaaaagtaaacgatggagcatgagaagcatattcttttcaaatgatttgatgtagatcaattatacaggcagacaaggcacatgcaatcggggttatcgctgttgtgcaacgccataccaatgataaaagttgtatgtgtgttgtgctaaagaagaatctcttcttctgtacatacaaagaggagattcttcacgatgttaattgttcggacgacaaagatgccttaattagttattcaggtacataaatgatttcaccgttatccagttcataggcaatgcctacctttttcccacgtttaccttctttcttgtcctgatcttcggacggggtataccggttgattttattgccttccttggtaatgatttccatattctctttacccggattctttaccatcgtatagtcttcctgcgagaaaacctctgtcatgttataccggctgacaagtgctaccatcaatgcaacggcaaaaaccatcgcaatgtcgaacagattggatactacgctgatcgggtcggagtcttcctcttttcgcaataggttatgtttcatttctctgaggttttatggatggaacgtttgtcattgagcaattcggatatgaattcaaggttggtcatatcctgcaggtaccagcgttgtttcacttgctgtgtaaggaagcctacggcaccggctaccagtccgactacagtggtggcgaaagcgatctgcatattgtaagccatggaagcaatatctccgctggccagtcctgcgagggcgggtcccattggaattaatgttcccatcagacctaagatcggtcccagtttggtcagggtcttggagatggctaagtctttgtccgctgcgatttcaaaattagccaataaacgttgtacctgtgccggagtatcacgggcgtccaatacctgacgcatataggtaatgacaagtgatctagaattttccggaagtttggaactcagttcttctactgtgtccggagtcagcttgctcagctcgttgcggagcagggtttccgttttacgaatggacagatattgaccatagaaactaccggcaagtaaaatcgcgcggcaaaagaggatgattaataaaacgatgacaggaacgagcaagcctgttgaaatccagtataaaatatctgatataaagttcattgttattgataatttgaagagttatttattctattattgtttcacacttttttctttgtttctgtttcggatgttccaccagagaagtccgagaattccgccagccagtgcgatgactatgacgcctgtcaatgctttccagtctatttcactgacacctgctgcggaagtctttccgttgactgtggcaacaattcccaaaacggctaccagggcattggttaggaaaaatagttcgaggcgcagttctttttccggcaacaaatagagcagtataaatctgccgcaagggatggctgccaggataaaggctgcatagctccatgctatcgtttgaaatgaagtacccggaaaagcaaagatgagatataccagcccgctgaataaaaccgggaaaatcaataatcccggaaaccagcggagaaaacggtacatgagtatcatgcgcggcttgaccggatagtcattggctacgtggacggcaagcatggcataagccatttgtatgcagacttccacactgaggagtacggaagtatctagcatcaagggctgattgcttagccaattggctatctgagtcttcgattgctcgatagcatacggccacatcaatccggcgaagacagcgcagatagcggtgataataccgaccgctattaatttccagaacgtttgcttcaacagaaagttaaatgctgtaagaagcataagtacaagaacaactgtatccattatatgattttacaatttacaagttacgattgataattcacaggacgtgggttacatctgactgcttttgcggcgcttgcgtacaaagagtatcagagcaagaataacgataatgacagcgatgcctacggctacattgcttaatgtatttgtctgattttcggctgtctgattcatctcttcttttttcatcaccactcccttgttgctgccgcttgcttttgcttcacggattttagagatattttctttgtactgtgtagcggtttgtgcgtctgctttcgatgcaatgaagtcacggagcttggcattgtcacaaacaaatccggaacaagacgggcggtaagtattgacaatctccgtatgaagtttgctaagttccgctacctgttcttcacttgcttgccacaatcccttacgggcgctttcgagcatgacggcagtcatctcttccaaagcggcaggattctgttgttcgaaatattgtttgactcccaagttcagttcatccttcacatatacattatatatattatcccaaagctctttgtcgattgcagccggtttcatcacattccatccataggtattggtgatcacttctgcaaattcacttgccgaagaagccccgcctttcattttctctttgatgtaagttgggttcaggatagtggtgcgactttctacgccgacagcctctttcagttcctgcatcttcatatggttccggttgcgataatcactgaggtaggcatccggatctttgccggtcacattgcgtacggcgagattcatacctcccataaattcgtatacatggtcaaggcttaaagctccccaggtattactttgccgtggttgtacgacaacatccgtccgggtcagtgcagcctcgaaagcgaacttttggaatacttcccaattcttttcgctgccgtaatacgcgcccatattattgagataagtatcggcgatttccgattcattctcccagcggtcgccggattctaccatttcctgaataccggttccatacataccgttggctcctccgaatacccggaatgttgaaatttcgcgggcatctttcgggcttaatcctttttcggtcagcacccgttcggcttctattacgctggaggcaacctgattttcatatttgtcgtctttggcggcggcagccatttctactgcacggttgatgaggaagagacgggaggcggcaagatcacgaagttgtccggaagtctggactaccacgtcgatgcgcggacgtcctaattcggttgaaggaatcagttttaaatcgctgacacgaccgaaagcatcacggacaggctcaacacctaacatataaagtacctgtgcgatggttgcccctccggtttcaataaactcggatgaccatagtgtataactgaccttgcgtggtatggagtcgttgtgacgttgcttgtacctatcaattgtctgcttggccaaagcaatacctttttcccaggcagactctgtcggagtcgcttcggcattaatggcatacatattacgtccggtaggtagcgtgttcggattagcgatcgggtcaccaccgggtgtgggagctgtgtatccgcctttcaaggcattcatcagactgctcagttcctcttccggacttgtcagaagtgcatttttataattgcctacattcttgatggtacgttctacttcagctactgcaagcgcaaattccacctcttctttgctgtattctttcggagcctttcccatagctgccatcattgctgacataccctgcggcttttcagtctttcctgccattgccggtttgcccgaagcgtctgtggatgtatccttattagccttcatgctggcttccattttctttaaagcttccggactggcacccattgatttggccatttccatcgctttttccgggtccatgttagcacccattttcttcatggcttctttcatgcctgcaggcattttaccatgaggtcctttttccatttttgccgaagccggatgaccattgcccgacggctcattatcagcctgatcctttttggctgcggcagccatcatcattgccatcatgcctttgggggcattgcgctcggcttctatctgtctcgcttttgccaactcttgcggagtgattccggctgtgtggcaaatcagttcgtcggttgccagtgaagggttagccatcagtctctctacgagaaggcgggcaggcatgagatattgctgggtaaagacacttcggtgtttttcggcagattctgtagctttgccgcgttgcttgtcaagagcaaaaagactataggcaatcggttctgttgccatcgcgtagacagaagaagttattctttccggttcgtaaggaactcccattgtgtaaagctgccccgtgattttctctgtagccagttcttcggcaaagttttctacacgggcgatttcatcttccgtatacggtttattagccatactgtccagtcctaaatcacgatggattcccatcttcacagtcaaggttttcacagccagcgactcctgatctttgtttgccttctgggagttattatagattttgatcttttccattaattcccggtaaatgccgcgtacgctgctttcaaggaaaggaggagtgagatatgattgcaaggtagcataagaacggcgtttggccatcataccttctccgacgtttccgatagagtagaggtagtagtggggaacggctcctaccaaacggtccggccagtcattgctgcataatgcgacttgttttctcggagtgaattcgagactgccgtgtgtaccgaagtgaatcagtgcgtcggctttgaagccatgttgcatccacaggtatgaggcaatgtaggtgtgtggcggagccatgtcggtgccgtgcaccacctggaaggagttgtcaccgcttccggcagcgttttgtggcaatagcacaacgttaccgaactgtaaacgggcaatacctaatttgccgtcaggagtcaccatatagttgccgggaaattctccgaaagcatctaccacctcctgatacttttcgggacgaagcgattctttcacccagctttcatactgttctttggtgatcagttcgggatgtccgttttgcatgaagtcgttgaaagctccttctgcataagcgttgaataccgccccctgggcttgtatcatttttcccagttcctgagcgttggcaggcagaccggatatattatatccctcttgtttcatacgaagcagaagattgtaaagggaaggtactacttccatgccggcagcggtcaatgcgttctgaccgggacctttgtaataatagatagctactttcttctcaaaattaggttttgttttcagattcaggtagttgtctattgtagatacaaaagtcttcagacgttcggggacggcatacgaatggcgcaatccttctttatcttcatattgtgcgaaaagggcgaaagggcggatagctccgtctatttccggtgttacgatgctctgtgacataaagcctcccgacatacccatcggatcgttttcccattcatccacaagactgttgattgtgagcggagcgaacaaaaggatatttctggctttcagataatcaaccattttatctcccatacgtccgtgtgccatattgatgacggcatcgggctgcacttcctcaatgaatgacatgaatcttgtcatggattgaacgggataaacattatatcccgcattctccagcgcttttatcagatcggtggcatctgccatttgtccggtaatcatgatttttcgtgccccttctttataaaggttattctcttgcatgaatttctcataatcggcaacggtaagaaattcctgttcatcatccggattactgattccggcatgataaagcatatcgctcggtctttctatcggatcttccacttcgggtacagcagaagcctttccgtcaatggctttacggatatagttcagcatattgcggtagttggtctttccgccgttgctcagatagccgcgtatgagattctgctgtatactgtcgaggttgcagatgttattggcagggttggtagccatagaggtgtatacggggatacccttatctgctgcctgctgtatttgctgacgttgttcttcgacaatgcgcagtcccatgccattgatgaataccatgtcataactggtcagacgatcgaggttgtcaagagacacttcgctgagtttgatgaatgaattgtcgttggctttcgagatgcttccctgctgtatggtctggaagttgacgaaagctattttggtagcgctgaaccaggtattccatacggatagacctatcagggctgctacaacgatgcatccacctaaaatgattttacttttctttttcatttctcttatttttagctttgtatgtagttctattgttgccgtttattttttgaagagcctgtctatatccagtgatagtcctaatgtcaggttggttcccgtcgtggtaggagagttgaaataataataatccggcacatagtcgaacaggttgtttacagccagattcatattgatcccttttataattcccaacgagaaagtaagatcccatatcatatatcccgggtattcgactgcctggcttccggcagacgggttgttgaaactatcgttgtagatgtttgttttaacttttgacagcaaacgtccgttgagtgagtagttgaaatctattttgttcagagtcttgccccagtcgattcttacagttgccgtatggggacgtgtatccgtgaatttcttttgaccgtcgcgcatgaactcatgaatatatgtgtatgacagacgatagccgagtccgcaaggatacttggcggaaacgttggcgtcaattcctgcaatatccattttgtcggtattggtatagatttgtcctttggggtcttcgctgtaaacggtattgatacgattgtgtaccaggttataatatcctgtaatagagaagttataacgactcttggtatattcggcagatacagagaaattatggcttgtttccgacttaaggtccggattaccataaatcatcatcatatttgccatattgaacaccatatacatctccttcagggtaggagagcggaatccttgcgaatacgatcctcttaatgaacaattgcctatcttatacatcattcccaaatgtggagacagatggcgtacattggagtcggagaagtagtcgaaccgtaatccggctatcacattcagtctttctgtggggttccagtcgaactgaccgaacgcatctgccgtatgcatggtgtggtctgcgttatcagtgaattggtaagacatcagataatcgcgcaggtagtcggcgccgacagtcagcgtatgctttccgttgaaggtataattatagagtgcatgcacattgtgctgtacattactgtaatcacgcacgtcatttttataaagagactgataatcactcttatcatactggtcgaaagtataaccgacttcaaggttactcattatattgaaggtgtagttagctttcattccaccgctgaatccacggtatctgtcctgggtatcccccggtttattgcgttcacggaaataatagccgactcttcccgtcagtttgagcgtttccagcggacggtatattaaacgttctttgaagttccacacccggcttccgaacactgtagagaaatctcccggattgtctacggcataagtgtctacattattatactgcacgttggtcaggctgttgaatttacctgcattaaatcctgcagtgccaccacaccgctggtcgttgtgttcggagaaacgtgaattaagatttaagttccatggatcgtccgattcgcgggtgatgatgttaattactcctccgatagcactggaaccgtaaagggtagatgcagcacctttcactatctctatgcgttctacattgtcgagattcagacgttcgtagtctacattattcagtgtttcccctgccagccgttcgccatctaccagaaacagtacggaattaccgccgaagccttgcatattaatagcggtttgctgatccatagagaaggaaaattcgataccgggcaactctgttttcagcaggtcggcaacgttgttggcattaactttcttaatatcgtctgaggtgataacccgggtgatgatgggagcgtccttcagcaatttgggagtacgggtaccggttacaacgactgttccgaggtcgaactgatcttcggataagctgaagttaactttctttcctttctcggtggttattcttttttgttcggtttgataacctatgtaagatgcagtaatgatatatgaaccgattcccggcagttgtaatgtataggttccgtcaacactggtgacggctcctgtttcttctccttttatggaaatggtcgcacctggtaggggttcaccattggtatcagtaacacgtccgctgatgtgctcggttgattgttgtgcgaatgtggaacaggttactataaaggagaatatcaagattgatgctataaatgtaggtttcattctttgtaattggtttcttagttgttttcttcgaaatcaagtggatataggaaatcgaagtcgatatagccttttatgcctctggcattggtatagttggtaaaacgaatggccgcataggtattatccttcaactgtatcagatagacttgattggacatggtgtaaataggaggcatacttgaagtgtctacgtttaaccagccggataaaatatcattacgatagtcttctgtatatttaatgtttccttccatcataccggacatatcgattgctattttatctgtcgtccattcgtcttttacaaaattttcttcggcgggaagttttccactggccttcaggtcatcaatacttgtataagttgtctgaaaggctgcaccttcattggttttgatgtcgtagcggtggatggcaaggtcccattttgctggtatctcgctcttatgttcctctccgatttcaacagtcgttgctttacgttcggataggtcgatatagacccagttagtgtactcggtagcattgatttgtgaaaagctactttctttaatctccatttccgcttcaatgggatcgtcataaatcccttcaaacattccattacaagctgagagcgacatagccgctcccagtatcattatatttttgaaaatagcgttactgcttcttctcattttttctattagttatttattgtgcactagtttttttgacgtttccggtgaatactgcggtgattgccataggcatggctcctggtttgaaggctaccgtaatattagctttaccatttgctgtaactgtaccttccagactttcacctgtaattggagtagtaccgcttgcggattcggctgcagattcaaatgcgcctaaactgagtgtgtagccgtcatctgctttttcaacgtttactccgctaatcgtgaagtctcccaaattcatattaccgcctccggtcaaattgccaaaaccgtttagggtgatatctactgtcgtttcggatgcacgtttaatgactgctttacaatcttcggtagaaccatatgaacttcccataacgctgatagcaagattagtattatacttataagtagcggctacgtaataagcaatcggagtttctgcctgaatgaaattgatatcgatgccacccattggcacaggaacattggctttcagggttagtactttagcatcgctgacactaccttccagtgtatattcgtagttggcaggttcacttccttccatagctagggcaacttcaccttcgcctttaaatgatttggaagaaactgtcaggttattcaggataaaatctccggatcctgatttataaaccagattgacggtaccatctgtattggcggtaattgttgcgctggcatcgtcgcccatcagataatcagagaacattctgctttcgccaatagaataacctttgtaagtgccggcaatggcttttgcttgctctgtattgtcggtatcgtcgttatcgtcactgcaagatacaaaagtgaatgagaatgatagtgccattagagcaaccatccataagtttaatattttcatacttaattttgatagataatgattaatttatttttcgtttgcaaagttagggggatatataagcagggacaatacctaaaagaaatgaaaaaaaatgggcgtttaatcatatataggtattgaatagggaaggataagtccttatttttgcagtcatttactaattaaatattaaaaatacgaaattgagaagagaatgaaaggtggctacaatagaaaagtgtattgacagggattacttatttcctgattgtattgtttactatgtctttagagcatgcattgatgatttttatggagcacgtgcctctatcgtaactttcatggaactgaatctcatcatgtggaccagctatttggttttattgttttgttatgatgaaaactttattggtgagcacagccctgtcaccgctcttgttgcattcttgatgtttgagaaaagagtgaactaatttcttagataactgtttcctaaatatatgatataaacctatttagaatatggaacctcatcatcacgaacataatcatcgggtaacgtctcttaataaagcctttataataggtatcgttctgaatatctctttcgttatagtcgagttcggagttggtttttattacgattctctgggattgctctctgatgccggacataatttgggagatgtggcaagcctgattcttgctatgttggctttccggttggagaaagtacacccgaatagtcgttatacctacggatataagaaaagtaccatcctcgtttctttactaaatgcagtcatattattggttgctgtcgggataattatcgctgaaagcatagacaagctgtttcatccggtatcagttgacggttccgccattgcctggactgccggagtgggagtggtggtcaacgcacttactgcctggctttttatgaaggataaggataaagacctgaatgtaaaaggagcctacctgcatatggcagctgacgcactggtctctgtcggagtagttgcttccggtattattatcatgtatacgggatggagcatcatcgatccgattatcggactgggcatcgctgtgattattattgtttctacctggggattacttcatgacagtcttcgattatcgctggatggtgttccggtgggaatcgatactcagcagattcagcaactgatagtggaacagccgggggtagaaagctgtcatcatctgcatatttgggccatcagtactacggaaacggctttgactgcacacgttgtagtggatgatatagcaaaaatggaggaaataaaacatcgtataaaggaggcgcttgaagcagcaggtatccatcatgctacattagagatagagggcgaggaagtgacttgtagcacagaatgttgtgaggattgaaataaatccgtacctttgcgcccttaaactaactaacctttaaaaaacatgtttactgacttattgcattcctcttatttctcgctctttctgatagtagcgttgggatttatgttaggaagaattaagattaaggggctatcgcttgatgtgtcagcggtgatttttattgctcttctttttggacactttggtgttattattcctaaagaattaggaaacttcggtttggtactttttatttttaccatcggtattcaggccggtcccggattcttcgactcttttcgtagtaaaggaaagacgctgattctcattactatgcttattatctgttctgcctgcctcacggcagtaggtttgaagtatgcgttcgatattgatacgccgagtgtagtcggattgattgcaggagctttgaccagtactccgggattggcggtagcaattgatagtacccactctccgttagcatccattgcttacggtatcgcttatccgtttggtgtaatcggagtgattttgtttgtgaagctgcttcccaaaatcatgcgtgtaaatttggatcaggaagcccgtcgccttgaaatagagcgccgcggacaatttccggagttgggcacttgtatctaccgtgtcactaatgcaagcgtattcaaccgtagcttgatgcagatcaatgcacgggcaatgacaggtgctgttatttcccgtctgaaacataaagatgaaatatccatccccaccgcgcatacagtattgcacgaaggagactatattcaggcagtaggcagtgaggaatcactgaatcagctgtctgtattaattggcgaacgtgaagaaggtgaacttcctttggataaaacacaggaaatcgagtccttactattgaccaagaaagatatgatcaataagcaactgggtgatctgaatttacagaaaaacttcggttgtacggtgacccgtgttcgtcgaagcggtattgacttatctccgtcaccggatttggctttgaagtttggtgataaactgatggtggtaggagagaaggaaggcatcaaaggagtagcccgcctactgggaaacaatgcgaagaaactttccgatactgatttcttccccatcgcgatgggtattgtgctgggggtcttatttggtaagttgaatatttctttctccgatacactgtcgttttcacctggattgaccggaggagtattgatggtggcgttggttttgagtgccgttggtaagacagggcctatcatttggtctatgtccggccccgccaatcaactgttgcggcagttaggtctgttgcttttccttgctgaagtcggaacctctgccggaaagaaccttgtggctacttttcaggaaagcggattactgatgttcggagtgggtgcagctatcacagtagtaccgatgctggttgcggtaattgtaggacgcttggtattcaagatcaacatacttgatctactgggaaccattacgggaggtatgaccagtactccgggactggctgctgccgattcgatggtagacagtaatattccaagcgtggcatacgcgaccgtttatccgattgctatggtattccttattttatttatacaggtgatatcttcagctgtgtattaatgaaaatcagtatatataggtattgattgttaaaataatagtttgtatctttgccgcctcaaaatttaagatgaggtgaaacgattgtcattgaatatcatgcgctgtttcttgccggtactgtttgtatcgtatttggtaagtatcacattctttgctcacatacacgtggtcaatggcgtgacaatcgtccattcgcatcctttcaagaaaggggcggcacataagcactcaacagtcgaactgttattagttcatttcctgtcacatctgacaacggacggtgcggctgttgtgtttgctctctctctttttattccattcctcttgtggcggttgcatggtattacgcagcatacgcactactattctccctatcatggggtggtggcactcagagcccctcctgctattcgtttttccgtcatttgaaccgatggtatcctgctttatggtaaagcgggaagtcctcatctgtttgttcacatcatcacttaacgaaaacgaataacaaacgaaaaatgaagaaatacatcttttcgcttgtctgcttgtgctgtgcattgttgcctgccctcgaaggacaagctgctctccatgagcatcccgaatatccggatttacgtaaatcggatgcaaacatcgtaggtcatatccttgataaaaacaccaaagaacacctgccttatattactgtggcattgaaaggtacaacgatcggtactgtgaccgatgctaccggacactactttttgaagaacctccccgaaggtaacttcgtgcttgaagtcagctcagtaggttataaaaccgtaagacgcaatgtaacactgaagaaaggccgtacgctggaagaagattttgaaatagaagaagatgcggttgccttggacggcgtagttgtttccgccaatcgtaacgagaccacccgtcgtttagcgcctactttggtgaatgtagtcgatatgaaaatgtttgaaacgaccaactccactactctggcacagggattgagctttcagccgggagtacgcgtagaatccaactgtcagaattgtggtttccagcaagtacgtattaacggtttggatggtccttatacacaaatcttgcttgattcccgtccgattttcagtgcactttcgggtgtatatggcattgagcagattcctgccagcatgatagagcgtgtggaagtaatgcgtggaggcggttcagctttgttcgggtcgtctgccattgccggtacaatcaatattattactaaagagccgattcgcaattcaggaatgttgtctcataccattaccggtattggagatggagacgctttcgataataatactgctttgaatgcctctcttgtaacggacgatcagcgtgccggtttatatatctttggtcagaaccgccaccgttcggcatacgaccatgatggagacggatattctgaaataccgaaaatacatggccagacaatcggtttccgttccttcctgaaaacgactacttattcaaaactgactttcgaatatcatcatatggaagaattccgcaggggaggagacttactgaaccgtccgcctcatgaagcgaatgtggccgaacagacagaacattccatcaatggcggtggattgaaatatgactatttctcaccaaacgagaagcaccgttttaatgtgtttgcatccgcacaacacatcaatcgtgacagctattatggtggcgggcaggatctgaatgcttacggaaacactaccgacctgaactggatggcaggatcacaatatgtctacagcttcggaaaatgtatttttatgccttcggacctgactgccggaatcgaattcaaccaggataagctggaagacaatatgtggggatatcaccgcacggtagatcaaaaagtaaatatcggtagcgctttcctgcaaaatgaatggaagaacgatcattggggattcttgcttggcggtcgtctggataagcataacctgattgatcatattatattcagcccgcgtgctaacctgcgtttcaatcctacccaaaatattaacctgcgtttgagctattcttccggtttccgtgcaccgcaggcttttgatgaagatttgcatgtggagaacgtaggtggaaatgtggcaatggttgagcttgcaaaggatctgaaagaggaaagatcacagagcttaagtgcttcagcagatatttaccaccgtttcggtgcattccagattaactttttggtggaagggttctatactaaattgtcggatgtctttgcattgactgatggcgaagtaaaagacggaattctgacacgtacacgctataatgctcccggagcacgtgtgatgggactgacactggaaggaaagatggcttatctgaataaattccagatccaggctggggctactttgcagcagagccattacagcgaaccgcacgtgtggaacaaagaagctccggcagtaaagaagatgatgcgtaccccgaatacttacggctattttacagctacttatactccggtcaaaccgttgtctatcgccctttccggtacctatacgggttcgatgctgatacctcacgaacctgttcccggattcctcgacaaaccgattacggtcaatacggaagacttcttcgatatcgctctgaaggcggcatacgacttcaaactctataagtcgatgaacttgcaggtgaatgccggaatacagaatatcttcaatgcttatcagaatgactttgataagggagccgaccgtgattcgggctatatttatggcccttcactgccgagaagtttctttgctggagtgaaaattagctattaataatggtttaataatctttttagcttataaatccttataaatggggattgtttcggaaccggacaatccctatctttgccgcagaagataaaccttatcttcgctgcacaaaaactgacgaatgaaacaaatatacctgaatataatgaagtggtttttgcctgtactgtttatttcgtacatggcagggattactttgtttactcactcccatgtggtaaacggggttacgattgttcattcacatccctttaagaaaggtggcgaacatagccatacgacagtagagtttcagctgattcacatattggaccatacattggtgacagataatggtttgacacctttgtttgtgacttctgtcctgtctcttttatgtatttttctcgcctctccgcagcgtatgcggtattgtcgtccctgtccgggcgccatttctctcagagcgcctcctgtcgtttagtctgcatcacgtagaagcaggcaggtcttctttggaaactgctgttgcttcccatccttattatttttgatttaaaacattaaaagactaacgacaatgaaaaaatatcttttagtcctggtcagcctatgttgtgccttgttgcctgcattggctgaacatccggagtatccggaattgaaaaaatctgatgcgaatataattggtcatgtattggataaaaagacaagtgagcatctgccttatattaccatagcattaaagggaaccactataggaaccgtcaccgacgctaccggacactacttcctgaagaatctgccggaaggaaactttatgatggaagtcagctcggtagggtataagacggttacccgtagtgtgaccttgaaaaaaggtaaaacgctggaagagaactttgaactggaagaagatgcgattgctctggacggagtagtcgtctctgccaaccgtagtgaaacgacccgacgtctggcaccgactctggtcaatgtagtagatttgaaactgtttgaaaccactaattcttctacattatcacagggcttgaattttcagcctggtgtccgtgtagagactaactgtcagaattgtgggtttcagcaagtccggatcaatgggctggacggcccctatacacagatactcatcgactcccgtcccgtgttcagtgccctttccggggtatacgggctggagcagattcctgccagcatgatcgaacgtgtagaagtcatgcgcgggggtggatcggcattgttcggctcttcggccattgcgggaacgatcaatatcattacgaaggagcctctgcgaaattccggtcagttatcgcatacgatcacttccattggtggcagttccgcattcgataacaacacctcgctgaatgcttcccttgtaacggacgatcatcgtgccggattgtatatcttcgggcagaaccgtcatcggtcgggatatgattatgacggagacggatttacggaacttccgaaactgaagaatcagacggtcggtttccgttcttatctgaaaacgagtacttactccaaactaacgtttgaataccatcatatgcaggaattccgccgtggtggagatatgctggatcgtcctcctcacgaagcccatattgccgagcagttacaacactccatagatggcggaagtctgaaatacgattatttctcaccgaatgaaaagaatcgtttaagtgtttttgcctcggcagccaatacggatcgtgacagttattatggtcccggcaacgatcctctgaaagcatacggaaagacgaccgacctcaccgctatgggcggtgtgcaatatgtgcacacattcgacaaatgtcttttcatgccttccgacctgacagcgggactcgaatataaccgtgaccggctgaaagataatatgtggggatacgaccgccatacggaccagacggtcaaggtttacagtgcttttctacagaacgaatggaaaaacaaacattggggaattttgattggcgggcgtctggataagcacaatatggtggatgatgttattttcagcccgcgtgccaacctgcgtttcaatcctacggataatatcaatctgcgtttgagctattcttccggcttccgcgccccacaggcatttgacgaagatatgcatatcgaaaatgtaggtggaacagtggcgatgatcgagcgtgcaaaggacttgaaagaggaaaaatcgcagagcttcagtgcatccgcagatatgtatcaccgctttggtgcttttcagactaatctgttagtagaaggattttatacgaggctgactgatgtgttcgtgttaggagggccttttgaccgtggtgacggtgtgctggtgaaaatacgcagcaatggtccgggagccaaagtaatgggattgactctggaaggaaagattgcttatctttctttgcttcaaatacaggcaggactgacattgcagcgcagccgatacgatgaaccgcataaatggcacgatgatgcgccggcagaaagaaaaatcttccgtactcccgatatctacggttattttacggctacttatactcccgtcaaaccgttgtccattgctctctcgggtacatataccggcagtatgcttgtgcagcgtatggacatcagcgcagaaaacgtagcaatgggcgatatgcccgagcgaaaggcggaagccatccgtacaccccggttcttcgatatgggagtgaagatagcgtatgacttcaaactctataaaacggtagacttacaacttagcggaggtgttcagaatatctttgaagcatatcagaaagacttcgacagaggagctaaccgggattccaactatatctacggtccttcgcttccgagaagtttctttgccggagtgaagattagttattgatacgataccggtctgttattttcagaacattttatgcatccgggaatgtgataaaacgattgcttcccggatgttttataaataagcgacagatttggcattgatgatttcaacgataatcatgtctgcctgaccgatttttagtatttttggcgattgtaagtaagcgattcaaagtcttatcagattgtattacggattatgataaaaagaagatggacgaaatgcttcattattacgaatgtaaaggcagtaaaataattagtttgaatgacctattatggcaacagaaaataaaataaagtattttgaaaatcgggaagactggagaaagtggctgatggacaactttgaaaccgaagacgaaatttggtttgtatttcctcttaaatcgtcaggtgaaaaaagtattgcatacaacgatgctgttgaagaagccctttgtttcgaatggattgacagtacgataaaaccgcttgataaagaacatagaattcagcgtttcacgcctagaaaacctaaaagtacatactcgcaagccaacaaagaaagacttaaatggttattggcaaataaaatgatacaccctgaatttgaagataaaatacgcacagttttatctgacccttttatttttcccaatgacataatggacagattgaaagaagatgaaatagcatggagaaactaccggcatttttccgacgcatataagcgtatccgaattgcatacattgaagcagcaaggaagcgaccggaagaatttgaaaagcgattaaacaactttatctgtaaagtgaaagagaataagatgataaccggatttggcggaatagagaaatattattgagattgtccgaatctttatggaagaatatccttatagtctgatggaagcgatggagcatcattagtagtaaatcactaaaaacttttctttcccttttagtagtttgcctgtttgagttgtattatatatagatagtcaataaaagtcaaagtaatcaacttattaaacagttaaccttatgttcaaacaactaagtacttctctactgattgcatcagcatgtattttgtcctcttgcacgcctacggtgaagcaggagattgcaattttacctacccccgttagtctgacggaacagtcgggtgctttcgtcttaaaggatggaatgaaaatcggcgtttccgatcagtccttatttccggctgccggatatttgcaggatattcttcggaatgtggtgtctacttctgtagaggtgaccgaagccgataaggcggatatctatctccagctagggcaggataatggaaagcccggctcttacaaacttcaggctacccccaagtctgttcaggttgaagccggagattattcgggtatcgtttccgccattgccagcctccaccaactgctgcctgccggaatagaagtgcagggaacgaaacagactttctccattcctgccgtgcaaatagaggactcgccgcgctttgaatggcgtggttttatgctggatgcttcccgtcacttctggaataaagatgaagtgaaacatgtgctggatctgatgtccttatataaactgaataagttccactggcatctgacggatgatcagggatggcggatcgaaatcgagaaatatccgttgctgacggaaaaaggagcgtggcgtaaatttaacaagcacgaccgtggttgtatggagcgtgcggtagaagaggacaataccgacttcctgattccggaaaacaaaatacggattgtagaaggagatactctgtatggtggttactatacgcacgaagatattaaagaaattgtagattatgctgcacagagaggtattgatgtgattccggaaatagatatgccgggacatttcctggctgctatcacccaatacccggatctcgcttgtgacggactgatcggctggggagaaacattctcttctcctatttgtccgggaaaggatacgacgctggaattctgtcaggatgtctttaaagagattttcgatctctttccttatgaatatgtacacatggggggtgacgaagtcgagaaaaataactggaaaaagtgcccccgttgccagaagcgaatccgcacggaaggacttaaatcggtagaagatttgcaggcatggtttgtgcgtgatatggagaaattcttccttgccaatggaaagaagttgataggctgggatgaagttgttgccgacggactgacttcggatgctgctattacctggtggagaagttggtcgaaagaggcagtgcctatggccacttcgcaaggacaaagagtgattgcctgcccgaatgaatatttctattttgattatgcgcaggataaaaactccgtgaagaagatattggcatacgatccgtatgcagacgaccgcttgtcacccgaacagaaagaatgtttctggggcgtgcaggctaatctctgggcagaatggattccgtctatgaaacgtatcgaatatctgatacttccccgtatggtggcgttgagtgaaatagcctgggtgcagccggaggcgaaaccggatctgaaagagttctatcgtcagcttgttccgcatttcaagcggatggatatccttggattgaactaccgggtgcccgatctggaaggattctacaaagtgaatgctttccttgatgaggcttcggttgatctgacttgtccgttgccgggcattgaagtccgttatactactgacggaagtatgccgactaagcaatccactctttatgaaggaaatctgaaagtgacggaaacgacagattttactttccgcactttccgtcccgacggtactccatcggatgtagcacgtacccgatacgtcaaagctccttatgcggaggcaactgctgctccggcttctttgaattccggactgaaagccgtatggcataaattccgtggtaatctttgtgcggatatcgatgcggctcccgtgaatggtgagtatgtcgtagaatccgtttctatccccgaagaggtgaaaggagatatcggcctgataatcacgggttacctggaagtacctgccgatggcatctatacatttgctcttctttcggacgacggcagtacgctgaaactggacggcgaattactgggagataatgacggagcacactcaccggtagagattatagtacagaaggccttgaaagccggactgcacccgatagaagtacgctacttcgattgcaatggcggagttttgcagatggaattagtcaatgaaaagggtgagaaagaagtgcttcctaaagaatggctgaaacatgaataaacagatctcctgaagattttttattaggtattaatatagatgaggtaattcttgttgaaatatccctataaatgggtatttcccaaatcaaaagttcttctcaactttgcagagtgaataaaacgccactatgcaatatttgaaagaagacatacaggaaaaaatcctccacatagccgaagaagtattctccgaaaaaggatataaggatgcttccatgcgcgaaattgcttcccgaacagggattacagtcagcaacatctatcattatttcaccaataaggatgagatattccgcacgattctgaaacctgtgctgaatgatttgtatgccaagatatatagtcatgatgccaatcagatgtccatagaggtttttacgaattcggactatcagcaggaatccgtgcaggaatatatcgatttggtttccgaacaccgtgcccggttgcgtatgttacttttccaggcacagggatcatccctggaaaacttccgttcggagtataccgatgcgatgacacgtactatctttgtcttttttcaggggatgaagcagaagtacccgcacctgaatataggtatcaccgatttctttattcatctcaatacggtatggctgtttgccttgctcgaagaactggtgctgcaccacgtgaagaaagaagaaatgcagaaatttatagcagaatatatagcctttgaaacggcaggttggaaggagctcatgaatgtatgagctccttctttttttgaacgattcagaggaatgttcttttttaaaaatcagatatatataaatgaaaaggtatgaaagaaaaacagagaaagaaaagtggtgtgagtcgcttgtttgagatagcaggtgagaagaaaggcttactgatgcttgccggggtactttcggcggtcagtgccttgtgtatgctggtgccttattggtcggtatatgaagtgctgaaagagcttttgttgcatggcagcaagataagcgagttggatagcagtgtgcttatacactggggatgggtggcatttgtcggtctggtggcaggactgcttttactgtatggagcattgatggcatcgcatgtggcggcgttccgtattctctacgggttgcgcattcgtctgtccgggcatatcggacgcctttcgctgggatacctgaacggtacttccaccggagcgatcaagaagactatggaacagaatgtggagaagatagagaattttgtggcgcataccattcccgatctggtcaatgtgctggcaaccattgtgctgatgtttatcatcttcttctccctgaacgggtggatggcggctatttgtgtggtctgcatcgtttgtagtatcggtttgcagtttatgaacttctttgggaaaaaagccaaagagtttacgaaaatctattatgatacgcaggagcgtatgagtgcttcagctgtccagtatgtgagaggaatgcccgtggtgaagatatttggtcagagtgtgcgctcgttccgccagtttaatagtgagatagagtcctataagagttatgctttaagagtctgcgacacctaccagcccggtatgattgcttttactgtattgctgaattcgctgataaccttcattttgcccgtaggtctgttgcttctgagcagagagacgcagaatattggtctggcggcagtttatctcttctttattattatggggcccggcgtggtttctcctatctataaactgatgtatctcggttcaagtacgaacgagattgacgagggagtgaaacgaatcgaccgcatatttgatgaacaggtacttcccgaaactgcggtttcgcatttgcccgcttcctatgatatcgagtttcgtcacgtatcgtttgcctacgaaaacaaggcggagactacccgtaccgaagcgctgaaagacatctcttttactgcgccacagggagcgattactgcgctggtcggtccgtcaggttccggaaagtctacggtagccaacctgattccgcgcttttgggatgtcagtgaaggggagatctgcattggcggaattaatataaaagagatagcgaccgaggatttgatgaatctcgtttcctttgtttttcaggacagctttctcttctttgatacgctctatgagaatattcgggtcggtaatacgtctgctacccgtgaacaggtgatcgaagctgcccgtgcggctcaatgtcacgattttatagagagtctgccggacggctatcatacgcggatcggtgacaaaggagtgtatttgtccggcggtgagtcccaacgggtttgtgtggcaagagccattcttaaaaatgctccgattctggtgcttgacgaggcgactgcttttgccgatccggagaacgaatataagatgcagcaagccattcagcaacttatcaaaaataaaacggtcatcattattgctcacagactttcgtccatcatttcagccgaacagatacttgtcctgaaagaaggcaagctcgtacaaagcggacgtcacgaagtgctgagcaaaacggacggtgtatataaaagaatgtgggatgcctataccagcgcattccgttggcaattaactatcaaaaaggaggaaacaaaatgaatgcaatcaagaatattacggtaggacataccgaacgtctgcgtaaacctgtcggttacacgatgcttgccaatctggtgaatatcgttccgttctgtctttctatcgaagccataaatgtgattttccgtacgtttgacggtagtggtacaccgctggatacgaatcgtctttggatgatttttgctatattggtcgtgtatatggtggtgatggcttttgccgaacgcgccgcctatcgtgccaactttcgcggtgcttatgagatgagtgccgaagggcgtattaatttagccgagcatctgcgtaaattatccttgggattcctgtcccgcagagatccgggggatctttcttccatgctgatcactgactttaccatggcggaaacgggaatatcccatcacttgccccaattgatgggagcgttggtaatgccggtttttgccttccttggcttgctttggattgactggcgcatggcggtggccatgttcgtagctttaccgcttgcggttgctgtcctgttgcttagcaatatcgcccagcgtaagctgagtgtgcgacagattgaagccaagattaatgccggaaaccgcttggaagaatatctgcaaggcatacgggtgatgaaagcatataatttgctgggaggcaagttcgaacgcctgaaaatggcttttagtgatctccgtcgtgcctgtatccggcaggaggcgcttctcggtccatttatcttattctcggtcacattgattcgtgccggattgacattcatgatactttgcggtacgtacctgttgataggaggcgaactttcactgctcacgtttgtcatgtttctggtggtcggttcccgtgttttcgatccgctgacatctgccttgactaactttgccgagtttcgctacttctccatcgcaggaggacgtatccttacgttgatgaacgaaccggaaatgaagggagatcgtgatgtgcccgaaagcggagatattacttttgatcatgtatctttcggttatcaggaaaaggaaatactgcatgatatttccgtgactcttagaaaagggacgctcactgctttggtcggtccttccggaagcggaaagagtacgatgctgaaactttgcgcacgcttctatgatccgcgtaaaggctcggttcgttttaacggaatggatatgaaagaactggagccggagtcattaatgaaacattgttccatggtttttcaggatgtctatctgtttcaggatacgctgaagaataatatccgtttcggcaggacagatgctacggatgaagagatcgtagcggcagcgaaaaaggcttgttgtcacgaattcatcatgcgtctgcccaaaggatacgatacgatggtaggagaaggtggctgcactctttcgggaggagaaaaacaacggatctccattgcccgtgccatgctgaaagaagctccggtcgtgctgctggatgaggctactgcctctctcgatccggagaatgaagtagaagtgcagcaggctatcaataccttgattgcgggacggacggtaatcgttatcgctcaccgcctcaaaacgatccgaaatgccgaccggattattgtgctggaagaaggacgaattgcggaacaaggcactcatgatgaacttttgagccggccggggctgtacgccaaactttggaatatacaggaacagacatcgggatggaaactataaaaacggctcatcagagataaaacgaaaaggtccggctttcacaagccgggccttttgtttactagaatttatgctatttacacttattctgtaatattgaatacattatatggtttttttaaactaacaaccaaatgtgagaatgcgggagaatcacttcggccgattccaatgttttcaatgtggctacgtaatttttaattatgactaattaattcaattctgatattgcaaagataggggctttgacgatttcctgcaatcacctgaaatgggtattcttgggcgggttactagcaatatatagtgggtctgaatcttttattccggaacatttgcagagtttcctgtcaacctgttcagatgacataccagtagttttccttcattatctctcaaatgcataccattgccttgacaataacggaagtatttgcatcgggcgcactcgtcttttttcatccatgaacggtcgcgataaggctggaatttcgtttgccatatttcccaaaaatcatcctgatagatatttccttgatggtagttggagcggatgctgctacaggcactgatagaaccgtcaatcaaaacggagccgactgatattccggcactacagaagaaaggagtattccgtacttcaccttcatagttacccaggaaaccttcgcagccgtaactcgcacggataattccttcctttcgggtgtcacggatgaagtcgagtacttgtttcagttcttctccgttcatacggaattccggttcttcggcggctcgtcctaccggaaagatggtagatactctccatcgtttgactccgagactgataagtaactctttcatagccggcaactgtggcaggctacggcgggtgacacaggtaatgacgtcgaatgtcagttcagggatagctgtgatttcccgtatggcatttacggcacaatcgaaactttcgggatgtcgtcgcatccagttgtgtacatccttcagtccgtccaggctgatggatatactacgcataccgctgcggatcaggttgtgaagccgttcgcgtgtgagacacaggccgttgcataccatgccccacgggtatccccgtcgggatatttctttgccgcaagtttccaaatcttcacgtacggttggctctccaccggagataatgacgaatacatcgtgcggattggtatgtgttgctatgctgtccagtacttttagaaaatcctgcagaggcatatccggagtagcgggagaggacttgcagtcactgccacaatggcggcaacgtacattacatcgtaaggtgcattcccaaaaaagctgtctgagcggatgttcttccactctttcgtgtttcatccggcgaaatatttctaaagccagccatcggcggggagtaagggggatgatacgtttcattcttcttcttttttctcctctttaagtaaagtgacttttccctcttttccaaggtcttgtattctaatcttttttgtttggtatgcaccattcttttcgccgtctacatctgtatactcaaggtacatttctgtatctttgggaggatactctttgaatttaaatgtattgattgctataccgcttaccgtacaatgctctatttcacgtgactcggtataggcagtatctgtaattaatgaatcttcttgattcatataactggatactacgcgaatgccattaatagtttctttttcttcattttgtacttgactgcttattataatgtcaggagtccagacgggaccgggaccataataacaaggttcgtcccagatctcgttattattgccacatccggaaaagcctaaagcggcgagcagacttagtagatatttgtttttcatgttgttaatgtgtttagttcttgttgggacaaagataattaatctttgaattggttgttctccattgttcgttttattttttttagatgcttttccaatgcaatatacacttctttccgataactgacaaaaatagttttatctgtttggaaggaatctttctttttaccgtcatagtgcggaatattggataaaaacaggctatacgagaaaatcatgttctcctctatttggcgggaaggcttgaatgacttggcaggtatgtaagaataaataccctctttacaacggtagggtttatacatttgcacaactccccacgaattaatctcatccacccggatgcttcttttcccgaacaggcttcgttcttctattctatcctcacaaagtaaaatcttactgggtaatgcccaatagattaacaggatagacaaagatatgggcaacaagaaaataaaaaggactttattctcacttaaattggatacacataaaaagtagatcataaatgcactgaatatactgcatattgcaactcctgcccaaacaaacttatttgtagaataaatccagaatgtgtttttttccaaacttttatctttcatatttaattcaattcttttacagaatccggattgccatgtttcgtttaaatcaagctatctttcatcattattcgtagttgtttttgtgtaggtaatgttttccatcctttatctggcgcttttagagtaaaccaggatggtacggtgtctaatattcgatgtcggttgggggctttggctaagaatgttacaaaataacgggttccgattggagtgtttttactctcgttaaatgatataaaaaaacttcctttatataaagtcttattatatataaattcatattttgcgctttgtcctctataagcagaaccgtatttaataagagttactatagaatatatgccatcctttcttacattgttgtttctaattgttgagacagcatacaatagaatgaatactataatgggaactataaatttaaaaatcttggtttgattaatcagcttcattgctattctatatcctttcatttttcttcattttttattgcaactaatgtccggtggctaaccgaccgttaagacaactcatttgctcgttagtggtagttgttcattactccattcggtcaatattacattaaaatcagccaacattaaatcaaagtcatacttaaccttcttatttagtttgtttgttatatgacttaatgctgataggatatattcgcttaatctttttttttgttcagaatgattcagttcactaaattctttttcaagggttatcactgcttttacttttccagtatctgttctgaatggtccaaactcaaagcgatttcgaagataatatccattcttttcaatctcttgtttggtaaacattgttagtaatttggggtataattctttttgtctcaatttcagtttttcatcagcgataacgtaattgcatttacagcaaacatggtcgtaataactaaatgaacactttagaataattttattgacagcctgaccatacaattcaggtcgcatttgtttgtttaattttgattgtaaatcattctcaatactttcaataacaaccttagagttctcataacagttaccaattgtacgttcaatccaaatgggatttttaggaatccaatttcgttgacttctaagttctataccttgtacatcttctttcgttttatattcccatgctatggattgcctctgaaagggatcatccgggctgaaatgataacttgtccttcctgcttccatggtaaatccgtttattcttcttgaccaaatggcttcgacgaaacgaggctctctgtgtttattgacaaagcaagtcatcgggtttccattaaagaaagagcctcttaatgcctcaagggcctcattagatccccaacctatgattgccaaactctcgcaaacccgaactgcattattccactcttctacatttttgtaatccgcatatttaagaaattcagcgaataaactatctcgcaatttgtcaatatcattttgagatttcaaaaaaacttcaagttcgtttaattcttctatttcaaatattctgttcatttgttttttattttaaccgctaatgtccggcagataattgactattaaggtgctttatcagtttgttagcaatctaattcatttctatttaataattcatcaatattatgcctctaaaaatacagttttgtctgatcacccacaaaggaatttgttagttttttcctctatcctatgaaaaagcatcccttgacagtcaacaatgatctgttgcatgatatgtttgatcaggaaaaggtaaagagcgggctcgtttttatctttaccatgctaggctggtatttatccacaggatgtgcgaattgatattctcccccttttgcatatattggaaaggatatgtgtaatagcaaaaagtgtgatactttctgtgatatcctttctttttgatttgatttaaagtaattccctatcgttgtatattgtagaattgcctcaaatagcggtttctcgctctctgaaagtagttcttctactcccggaccggctctcagagtgcttcagcacggggcttagtagcgtgaagagtaaggttagataaggtatattgtgcgtatagtgtaactacagcctgcaaatagcgtaactatatcctgtaaatagcgtcagtatctactccccataaatagcaaaaacagtttgtacgatatatatttctttccacaaagtccgtcttttgttattagatttttctgacttgatttaattgacggtaattttctctttccaggttataccacttatatctgtcagaattagttcgtagtcacttttgggcaagtccataaaaacatcacttctgattgtaagagttgctttacttcctaaaggaatgatgaggctgtgttttcccggagctactttggctacatagtcattttttattcgggtaagtgggaagcgggctagctcttctccattcttttgaagtattgtttttccattctcgtcttttagtgttatgccgatcaggaaggaaccgtacacgtcggctccttctatccggtatactttgaacgtgaggatatcctcttgaatctttgcattggatattttcagttccggtttgaccgatttgttgtgcaaaggtccccaaataccgttatggaagacttggttagtatataaggtcagtatgaaaagcagtactgcaccgcttattgcgactttactgaattgcttgatagatagtggaagttcaccggaagtaagccatacaagccatttgttcttggaaagttttggtaataacagataatccaaagaatattttccaccaccggacaggaaaatagtgaatccggctgacactcccaagatgccgatttgccattcgtcgaggcaggtagtgcccagccagccggagcctaaaagaatgccgaatgccagactgaatacgccgatactcattaatcgtgtgaagaaaccgagcatatagagtaacccgacgatgccttctactaatgtgaaaattaccattgcccaccaaagtaaatccggtgtgctgaccaagtattcaataatcggtttgataccaatggaattgggaaggaaatgattgaacttttctccaatgtatccggtggcatccggaatgagtttgttttcgagaacgagtctgcgccaaaaagctgaaaaataagtccagcctacgatcagtcgtaaggagagagtgaaaatgcccgcaagtacgtaggctttggatggttcttgttgttgtgtcagcatactgtttgttgttagtttgttattgagagaatcgtttcttattagaacaagtttccagtggaaaatgtttttatgaaaacctgttttttttgaaacgattctactcaagataaactacatacaaaacaaagctaacaatgcaaaagttattctttaaacggctatctttataccttcttttttattacaataccgtttgcattgttggcaaaggtcgtatcccagcatggctcccaagatgaagtcctcttcggcagacagttgattcaaggggcgaatgatgatatgccgcatggcttccatacattcgggtttgccgaaaaacagattaatcttgttagtacctacttcttgtatcatataactgatcttctgattcttcagccggcggatggcaaactcttcgtgctctctgctcatcgtatagagtaccatgttgcgtacgcctttcttgaactcataaatgtggttgaggaaaatccggatttctccgggaatgattctttcggtagccatgatgtaaactgttattttatatggagataaagattagctgatttcttgttttacttgttcaacccatgcgctgatacgttcatctgtctgaccgtcttcattgacttcgtcgagtggaagacctacgaacttgccattaacgacagcgatagaagaatcgaatgtataaccggctgtgtccaccgctccacagaatttgcagcgggtatctttcagttcttcataaagaataccgatagcatcacagaacgtatcgctgtaagaatcggaatcaccacaaccgaacaaggctacatatttgtgagacagatcgcatttctttaaaactttaataccgtcgtaccagtcatcctgcaattcaccggctccccatgtggaactgcccagtaccagtacatcatattcaccgaccaaagcttcagtgagtttggatacatcataaatatgtgcggaaggaacatctagtttctctgcaatccgacgggcaaggtcttctgttgttccggtagtggaaccataaaatactccaattttattcatctttgattctattttaatgtgatggtgcaaagatagagggtctcggagaaataggaaatccccatttatagtggaataattgctttattctcattataaatggggatagcataacgtttcggatctataaataggttaaagccaacaaacctgatataaatcttaaaatatagcagaaaacgattaatgatggaacaagcgaatgcctgtgaatgccattgccatattgtacttgtcgcatgtaccgataacatgatcatctcgtacagaacctcccggttgtgcgatatagcttacaccgcttttgtgtgcacgttcgatattgtctccgaaggggaagaatgcgtcagagcctaaagctacgccagtcattgtatccagccatgcacgtttctcttcgcgggtcaggacttccggcttttctgtaaaaaactgttgccaaacgccgtctgccaatacgtcatcatgatcttctgaaatataaacgtcgatagtattatcacgatctgcacggcggattttttcaatccaaggcagattcatcactttcggatgttggcggagataccagatatctgctttatttcctgcaaggcgcgtgcagtgaatgcgtgactgttgtcctgcaccgataccaatcgcttgtccgtcttttgcataacatacggaattggattgtgtatattttaaggtgattaaagaaatgattaggtcacgtttggcttcagctggaatttccttgttttgtgtgggcatttccttcaaaagactttcgtctattttcagttcgtttctgccttgctcaaaagtcactccgaaaacatctttgtgttcaataggagccgggcggtaagccggatctatcttgatcacattgtaagttccttttcttttatttttcaggatttccagagcttcgggagtgtaatccggtgcaatcacaccatcggatacttcacggttgataatgcgtgcagtctcttcatcacaagtatcggacaatgcgatgaagtctccgtaagaagacatacggtcggcaccacgtgcgcgtgcataggctgttgccagtggagacagttttacatcatccacaaaatagattttcttcagagtgtcactcatttctacagccacagcagcacctgccgggctgacgtgtttgaatgatgcggcagccggaagtccggtagcttcttttagttctttaactaactgccaactgttgaatgcatccagcagattgatgtaaccgggacgtccgtttaatacctcaatgggtagttcgccttctttcatgaagatacgggcaggcttttgatttgggttgcagccgtatttcagttcgagttcgtttgccatattatttaattatgaattactgattacaaattgatagcgacaaaattactaaaaaaagaatagccagcctagcctcctgttataaattagtaacaagtaattagtattggggaaactgtgagtagcgaaaatacctatttgtggtgattgcatatcctcgaaatattccgtttctttgcagtctctaatataaataggtgtaaatggataatttgcaaaaatacaaaccaactgataagatgattgatctcatcagtgataactattccttgttacaagtgatgagccgtttcggcctttcgttgggatttggcgacaaaacagtgaaagaagtttgcgagcttaatggagtagattgcaggacttttctgattgtagtcaactttatgtctgaaggtttctcacggatggatggaagcagtgaggatatttctataccagcactaatcgattatctgcggcaagcccatatttacttcctggacttttcccttcctgccattcgtcgtaaactgattgaagcgattgactgttcgcaggatgatgtagcctttctgattctcaagttctttgatgaatatacacgagaggtacgtaagcatatggattatgaggagaaaacggtattcaagtatgtggatgcgctgataaatggcaatgctccccggaattatcagattagcacattctccaaacatcacgaccaggtgggagagaagctgacagaactgaaaaatatcatcattaaatattgtcctgccaaagccaatgagaatctgttgaatgcggctcttttcgatatatacgcctgtgaggccggcttggaatctcactgcaaggttgaagactatatttttgttcctgccattctgaagctggaaaggaggattagggaaaatgaaaaataacgaagccattcgaattgcgatcgccgaaacctcagtgattatccggggtgggctgaccgctgcattgaagcgtcttcctaatgtgaaggtgcaacctatagaattactttcagtggaggctctgagtgattgcctgcgtacgcaatatccggaaatgctgattgtaaatcctacttttggtgactactttgatgtaaataagttccgggaagaaactgccggtaagaaaatacgtttgattgctttggttacctcttttgtagatgcctctttgctgactaaatatgatgagtcgatttctatctttgatgatctggatattctttctaaaaagattcatggtctgctaaatctagcttcggaagaggaggagcttgacaatcaggaaacgcttagccaacgggagaaagagatagtggtctgtgtggtgaaaggtatgacgaataaagagattgcagagaatcttttcttgtctatccatactgtcattactcaccgaaggaatatcagcaagaagctgcagatacacagtgcggctggtctgactatttatgcgattgtaaataagcttgttacgctcaatgatgtgaaagatttataaccttcaaagaatgttataaaatctgaaaccgtttgcgaacacggaatctttttgtacctttgcagtgcaattgagaaattgctattagtttaaaaggtaaaagaaaagattattaaggtattagatttaaataattaaggttttaaattttttagtattcaataggacatttttggtaaaaggtaaaaaggataacaataggtaagaagtttaaaaggtaaaaagaagattagttttcaggaattgaggtaataaaagaaaagccttcctggcttttctgatgctgcggcgagtggttcccttctaggaattgactcgttttttgtttatagacgcaggggagctgaaaggtatataaataccgggattgctaatggccgggattggtataaaacaaaatcccgacgaaatcgcttcggcgggactctatttcatttttacttaaatgtggctacgtaataaaattatgactaattaattcaattctgatactgcaaagatagtgcgtttctgtatctgtcacaatcccctttataaggtatattgcgtagctgttctcactattaatgattagtggtggatatcattttacttttttccactctttcgttgcgaaatcatatgatttgatcactttggcagggcaaccggcacaaatagagtatgccgggatggaacggctgacaacgcttccggcagccactacacaatgtttccctaaagttactcccggcagtatgacggagtttgcacctacccatacatcatcctcaatagtgacaggctgtgtacttactccttgttcgtcgattgatttctccgcatcttgatagttatgattaagtcctgtgactgttatattctgtgcaagattcacatgattccctatacgaaccggaccgataatggtatttcctaatccgatgcgggtataatctccaatgattaaatctcctaccgcattattaaggcaggaaaagtcttctactaccgaatagcgccctagcgagaactgattaaaaggaggaaggtctttgcggacactgcgataaattacggaaccttttccacgtttcagatatacaaaatagaaaaggcgtatccaccagttgggacgtgtctttacgggatgcataataaaacgatgtacggcttgtttcaaagccggattctgtttgattcgctgtttcagtgtccttttctccatattgaatatttttgtttctttttatcttctactaaataattcggtattgccagactgtatgtgattgccaatcctaaaagcaatatccaccatttgagtgacgaggtccagtggtatcctgttatcaataaagtccagatactgacgaaggtacataatttcatcggagaaggtatcagctgctgggctatacggttgcagaaattccagttgccttctaataaagacggcaatagataagagagggtcttccgtatgcgcctgcgatagggataaacaggggctgagtcacaatgtacaatcacatccggcagatattcaatatatatattctgtttgaataacttccgttcgagatttgttttggcagttctttgattcttctgtagccattctaagtcgaaagccatattggttccgaaaagacttgaagaaaagccgatctgagtattccccgatctgaaaagactgttattgatttcttcggatagagcatggaaacgtttccgtactcccttacgattattaatgatcgtgtgtaactgcattgcctgtattccggcatcgtaggcattataaatcttttccagaaaatggggtgataaagcactggctttatcagaaagaaggatgactaattcgtatcgttctttatctaatgaatcaattgcttccagcagatctttatatgtgatgaattcatatgcttcctgttggtatattgaaggaaggaggcttccgtaaggaactaatatggcacactgatattgttttctggctttgggataattggaatgtttgaaatgtgaggcaacagccaatatgaaaaggtataggagcaaaagccctatacacaaaaagaagaaatcgtctgctatgtagataaagttgtccattctgcagtgaaagagttatacgttctctttttgaacgaatgcagtaactgttttcagaatgatttttatgtccagtccgaaagagaagttttttgcatattggatatccagttgcttgcgttcttctgcggagagtttacccgcttcacctcttttttcaacctgccacagtccggtaagtccggctggtcccataaaacggtcgatatgttcatcgctggtcagtaactctgcctcatagagtgggaggggacgattgcctactatagacatatctcctttgaggatattgataagctgtggtaattcatcaatgctgtatttacggataaaacgtcctatctttgtgattctggggtcattctccagttttacgaaagcattacttttctcttttgatttcttgtgaatatagtcttcttccgaaattacaaaatcgtcggatatcaggagaatttcttcttcgtctgcttcttcagagacattggattcttctccccatatatcttcttcctcttgttcttcctgttggtattggttgagggcattgaaatccttcagatgtttatcagcgtcggtatacatcgaacggaatttgagaaaatcaaatatctgataattgcttcctacacgtttggatttatagataatcggccctttgctctccaggcgaatggctatagaagttgctattaaaagaggagaaaggaaaagtaatgctattccggaaaagaatatatcgaagattcttttccacgaaggcaagcgaaaggcatttaaattctgtgttttgagttgcagcgcttctattttttgttcttttctacgtatgagaaaagttgacagatctttcagtacttcactgttggtttcatacttaatcgtgttattaactcctgccttcaagtattctgtagcttcttccttagtaatggaatctataactagtaccatataaagccctggatacatttttcgtatagagcgaatatcggcgatatcttttgatagttctacctgctcaataaataaagctgcatcgtatttttctcgtatcttgtctagcactttagttgccttatagcagtttggtgctgcatagaatactccggtacttaatttcgaaaacagttctattgttttgttgtgtctgcctatgtaaacaaaatattgcatttaaaggctgtattagtcgataatctttttgattcggatttttagttccaaaggattgaatggcttcagaatatagtcttctgctccttcttccagtaatttgatcctttccgtggtactttcttcgctggacagcataacgatgggaattgacttgaataactcattggctttcatgtatctgaggaattcatctcctctcattagcggcatacggatatcggaaataatgagatcgggtacattaccttcattaagccaatctattgctttaataggattttccaaatacataacatcgtaatccttacctagatatatacttgcaacttttccaatagtcgctttatcgtcaactaatagtatcttttttttcatacaaatagaacctttctatcgcttgctttgctacttgatttatatagattaaattgaatctcttgtctttgtttcacttcgtgcaaatatatatataattttagaataaatttccaattagcagaagtaaaattcatggagattattatttttatttattaatagaatatatctgatacatttagtgaggaaaaaaacacggatttcattttttttatgaaatccgtgttgataagggagattagtttttatttgtttggaataccttgtttacatcaaaatcattccaccatttttcattttctgtaccaccgctcgttacccagtcgctgaattgtgaataagcagttttgatatttacatactctaaaggccatttgaaattggaaggaaccatgataccccatgccagattctctttactgatataatattttttgctgccatgatgactgttatcgttgtttccgccaaacagatcggtgtttgcgagtttggttggttgatagcctgcaacatgtatttccttacgtgggtttctgttgccgtctacgatgataaagacattcaaattgttgacattaaaagcatctgctgatattgtcggattattgaaggtaatggagaaactgatattcttaggtttggtattgcctgcatagtctgagacagtattaatctgctcataccgatctcttcccaatactttatgagcatcatcaaacagaggaatcacagcataatcctgaccactttcgatattgttattatttagattgaaattcttggcaagagtattgtcactgaattcaactgactgtgtaatggcattggcgggtacattgtccagcataatagctgctccgatgcttttggttgctccggctgcggataagtcaatacttaactcgaattttgttactttattctctttattagtatatattttccttttctgaatggtcagaacgatatcattcatatcataatctccatatagtggccattggtcttcgaagaggtaagtataatctttgttgtcttccacttcaatagggaattcaggatcttccgggtcaggggtagggtcaggtatttctgaaagttcaccacatgaagtaatgattgttttggaaccattcgggatatataattctactgaattttccataatgtaattagggttattggcaggtacccctttggcgaattccccttccgggcattcaatatccaaattaccattgaacttagttgtccaaccagtagatatgctttttgtggattttattaatgaacgagttccggcagctttaaaagtgacattaggaatatccattatctctgcttttatcatagaaccattattcagttcaaaagtgcttccgctattaccgcatttaaaagatggaatagctataaaagtaccattttctacgccaccagccaatatacctttattcattatgatagttccgcttgttcctccgaattcgaaagaattttgggcataaagactgcaattattagtaaaagtagggttaccgccattatcattacttattttttgagcattaacagttccatcatttacaccaatcccacctataatgaaagttggagtattaattgttgcttcagttccattataaaaatagcatgttgcatcttgagaattaaactttaatgcaccttcttgaatagtcaattctccaaagttataaatagctcctttggtaaatacggactgttcccaagaagcaacagattttcctgtaacattaattgtggctttaggagcattgtataaaatagacgtcgtattcaagtccttcatactattgacactaattgttccaaaatttttcagtaatactcctatggcagcaagattgatgttattgccaataagacttccgcctgattgaatcgttaatattgagttgtcagcaataagaaaactcgtgaatgaatcggtgttgatttttccacccttcaaaataataatatctgcactttgtatttggttttgcgagggtgtccattcaccttctacaaatatggtaaatcttccgccattcaaatatccactggtatggttgatttcaccattaaatttgttttttatgatatagcttttgcctgcttccaaatgatgatttgattgattccaattagtattacctgtaagttcaatagctcctgtggtatcataagtttcttcgggatatttttctggaatattatagcttccgatggtcgcttttgcaactcttgtagtccttgaacctacaaattctttatttttagatacatcccatgtactaatagacactctgcttctagagtctgtcttacgaatatataggtaattagttccttctgtataatttatttcttgtgaaaaagcttgacctttcttggcaactcctttggcaagtatatggtaatcagacgttgaaaatggatttgcgtccaatatttctatttggttgtaaagttcatcatcaatttctatgtttagaatactagttgtagtcatattccagtcaaatccatccggtgcagcaaaaccgtctcccattggattggctgtctgataagacggatcatatagatccttctcggaatctacgcaactggataacatgcttactattgctatcgcaataatagatgtaagcagaattgtttttttcatcataatgtctattgtttgattgtttttttgtttgctgcaaagatagttgtatattttggattaaagatgtatttattgatatttcttgtgtaaaaagcaacgataattccgttttggttcgctttatatgaaaaacgaaagaaaaacctcctgattttttcttttgcagaaatattatagaatgaaaatcaggagattactatagagatttttttttagggtttggtaatttcccctattaaacaagagttcattttgtatcggatgtctttattagatagtccgtgtcccagcaaaaacatcagtttagttacagcacattcgggagtactgtcatatccactgataacacctgcttcgagtagatgcattccggtctcgtaacgtcccatttctactgctccggaagcacattgtgtgatgttaacaatgataattccacgatcagtagcctcttttaattcccggatgaaccattctttttgcggtgcatttcctgatccgaatgttttcatgacgaccgctttcaatccggggacatggagtagtgaatgaatgatctcctcctggatgccggggaaaagagttaatattaccacattcgtatcaaacagatagtgtggctttagtggtttgtccgggtccggtttgcgaataaggttgggctcgtatttaatatggatgcctacgcgtgccaatggcgggtaattgaaagaccggaaggcattaaagttctcagcattgatttttgtggtacgattaccccgcatcaagtgattttcaaagaaaatacatacttcggggacaatagctgtaccgtccggattcttggcagcagcaatctcgattgcagtgatcagattttcttttccgtccgtacgcagcgttccgattggcaattgagaaccggtcagaataacaggcttactcagattttcgagcataaaacttagggcagaagccgtataggccattgtatccgttccatgcaaaattacaaagccatcgaaatagtcgtaattatagttgatgatctttacaagttttgcccagtaagctggttccatatccgaggagtcgagaggaggatcgaattgataggaggaaatgcgatagttgaatcttttcagctcaggaacgtgcttgagcaaatggtcgaaattaaagttttctaaggcacctgtctccggattttctatcattccgatagttccacccgtgtaaattaacaaaacggaaggggtctctactctcataattgatgaatttctgttaaaacgctgacaaagatatagattaattgcgaattatgaatagtaaatgatgaatttgttcgtagtttgcagtgaaatgttataaatctgaatatttatgcgtaattatacgatggattaaaagaaaaaatcaagtgagttgtaaaaatagtcaagtagctaaaattgtttggaaagaatggttatgcaaagcaaaacgatactgcccggctattttagctaccatttgtctgactatttcttatgtctatttaagcgcatctttcagttttagaatggctttttccggatctttttcttcttcaagcagagtgacaaagcggctaccgatgatagctccggaagcatgttcgcaagctgcttgaaaagtagctttgttggagataccgaaaccaaccattagcgggttgcgcagattcatatcttcgatctttttgaaataggcacgtttctgttcattaaagtcttgttgtgcgcctgtagttgctgcggatgaaaccatatagatgaatccgtctgtatgtgcatcgatctcacgtacccgctcttcgctggtctccggggtgatgagcatgattactttgattccataacgttcggcaatgatacggtagtgatcctgataatctctgaaaggcaagtcggggatgataacgccgtctattccgcattccacgcatttgcggcagaagttttcaaatccgaactgcataatagggtttaagtatcccataaataccaatggaatacttacttcctggcgaatgtttcgtaattgttcgaaaaggattttcaatgacattccgttgcgtaatgcctgagtggcggcattctggataacgatgccgtctgccatagggtcactgaatggaataccgacttcaatcatgctgacgccatgtttttcgagagtacggatgacattgactgttccatcaagggtaggattacctgcacaaaaataaatagaaaggatgtctttcttgttgctattaaagagttgattaattctgttcatgattttgagaatttaattttatgactttagttcatttagaaatatccggattcgttccggatctttttccccgggcttcagttcgaaacgactgttcaggtcgtagcctgccagacggggatggtcgaatgctttcaatgcattggcactgtgtgagttgatgccgccactcaataagaatggaacttgtccgttgtaggtatgcagaatgttccagtcgaattggtttcctgagccaccatactgctcacatttcgtatcaaacaggaaaagattgcaagttttttcatactcgcttacgtgattcaaatctttcggacgagctacagaaaaagctttgatgattttcaggccggaggtgcgcaatgactgacagtattccggtgattctttgccgtggagctggatatattccagtccaaaacggtcggcgtacatcgtgattacatctttgtcttcatttacaaaaactccgacacggcgggcatgaacaggtaggtaagcgggaagttcgtagatataacggggagatttgggatagaagataaatcccatcatatccactctttgtagtgactccacatcccgtatattttgggcttcacgcataccgcatactttgatgatttttccgttgatcatagggctgtccgtttttggaagttcatatatttattggatggctttcagaaagttctgcagagtttctcccggttgcggagttttcataaatgtctctccgatgaggaatccccggaatccggcggtccgaagacgttttaccacttccggatcggaaatgccactctctgatactaataccgcatcttgtggaagttgtcctgccagtcggaaagagttttctacatctgtgaagaaagtacccagattgcgattattaatcccaatcatatcaattttgctattaatataaggtaactcttccgcactatggatttcaagtaatacttccagtcccagttcatgcgcctgctctgccagttcctgacatttttcctgtttcagtgcggcggcgataagaagtacggcatccgcaccgacaatttttgcctgatataactgatactcatcaatgataaagtcttttcttataatgggcacatcgaccaaaggacgtgctgtacgaatatctttcagacttcctccaaaaaacttctcatcagtgagaatagagagggcggaagcacctgccgcaaggtatgacggaacaatttcttcgggacgtgcctcctgtttgatccaccctttggatggcgagcgacgcttaaattcggctataataccggaatcggaagaagccaatgcccgtttcatagaacgggaagccggaacttcattgataccttcctgcaactgttcgatggaaatagcctgcttttgcaaatcgacttcaaaccgtttgttagctataatttcggataatatatctttcattaatcttaaatttagaatcaaggcaaaggatatcgcatattcatcctttaccacttatcatttataacttattacctattacttattattcaattcaatgaatttcttcagtgtagccaatgcccggccactttctagtgattctttagcgagggcgatgcactcttcaatcgttttttccggacgaactacttgaatagcgaaagctgcattgataacaaccacgtttttctgtgcttccgtagctgtattgttcatgatgttatcaaagattttagcagcatcttccggtgtctgtccaccatccagatcagtatcctgataacgtgcaaatccgagaccttccggagtataaatcttctcattgccacaggtagctaccttaaactcgttcgtcagagaaatctcatcatatccgtccaggctatgtacaacggcaaatttagtcttactctcctgataagtataggtataaaggcgcaaaagtggaagattatacacgcctaaaagctgataagtcggcaacaccggattgaccaacggaccgagcatattaaagaatgtacgtaccgccaatcctttacggatcggggcaactgccttcagtgccggattgaacaaaggagcgtgcagataagcaatattacattgttccatgctgcgccgcatctgatcaacatcacttgtgaatttaaccccatgttgctccatcacattgctggcaccgctgactgaagtagctccataattgccatgttttactaccggaatacctgctccggctactgtaaagcaggccgccgtagaaatgttgaacgtattttttccatctcctcccgtaccgacaatatcgatcggagcaaactcgctcaaatcaaccggaacccgcatttccaataatgcatcacggaatccgcataattcttcgacagaaatattacgcatcagaaagacagtaatcagtgatgctacctgtacgtcattatatttcccttgtgcgatgttttgcaggatagtacgtgcttcatcgcgtcccaaatattggtgttcgaaaagtttatatagaatctgtttcataagtttattcgtttaagaagtttttgatgatttcttttccttgcggagtcagtacggattcgggatggaactggatgccatgtacatcataggttttgtgacgtaatgccatgatttgtccttcctgactttcagcagttatctccaggcactcgggaaaaccttcccggctgactacccaggaatgataacgtccgacaggtatctctttgcccagcccttcaaaaagtacgtctttctgcaggatgctgatcggtgtctgtacaccgtgatatacttctttcaggttttccagtcgtgcaccaaaagcctcgccgatggcctgatgtcccagacaaacgcctaaaatactctttgtcggtgcatatcgtttgataatgggcaatagcaagcctgcttcttcgggtattcccggccccggtgaaagtatgatcttatcaaatcgttccacttcatcaaggtttatctggtcgttgcggactacttcgacgtctgtagctcccagttctttcactgcatgcagcaaattgtaggtgaaagaatcatagttatctaaaagtaaaattttcattttattgttattgtaaaattgttgttcaaatactgtttctgacttatcaggcagatcgctctgaacagttagttttttaaattaacagctaaatcgatagcctttttaagagctcctaatttattgtttacctcttgcaactcgtattcatcctgactgcgtgcaacgataccgcctccggcctggaaccataactcgttattacggctgacaaaagtacggatggtgattgcctggttcagttctccgttaagtccgataaagccgatacagccgccataagcaccgcggttatgaggttcgatttcactgatcagctgcatggcgcgtactttcggtgctccgctcaacgttcccgcagggaaagtatcgatgaaagttttaatcttatccgccccttcattcagctgaccgctcacgcggctgaccagatgaatcacatgactgtaatactgtggttccttataaaacaatacccgtacatcatggcaattacgtgaaagatcatttcttgccagatcaaccagcatcacatgctccgcgttctctttcggatcggcaagcagtgcttccgccaattcgcggtcttttaccgtatctccggtacggcgggttgttccggcaatcgggtcgatgtaggcacgtccgtcttcaattttacagtgagtctccggagaagaaccgaaaatgcggtatcctccgaaatcgaaatagaaaagataaggagaagggttgatgctgcgaagagcacgatagactttgaaatcatctccggcataaggctggatgaatcttctggaaaggacaatctgaaaaacatcaccacgcatacaatgggcaatacccttgcgaacgttcgctttatgctcctcatcggagatcgggctgctgacaggacctgtcaccgagaaattataagaagcataatttctgttttcgatagcggcctccagttccggcaaaccgctttcttcaccttcgcccagcatttctaccaatgtcaattcattcttgaaatgattgaaaacgatgatatacttatataatatgtatagcaagtccggagcatcattctgctcatcatgactttctttcaccgggatatgttcgaagtatttcactgcgttgaatgtggtgtatccgtaaagtccgcacacattcttgttttctccggtcacttgaaactgactgatgaattgattcatcgctttttctaccgtgaatgattgggtgagcggctcttccttccgactgttgtcaggataactagcagtgactattccgctattgacaccgatacttgccagcggacaaagagcgatgaacgagagggaattttctcctgcatgataatcggaactctccatcaatgcagattgtgggtacatatcacgtactttcagatagatactgacaggagtgtgcatatctccgagtacctgtttgctatgggctgtataactgaatgttttcatttttataatttctaaattcaaactacaaaactagatgttgataatcacttttcattgaaagacaaataagtttcaatgtctttgtcgccacgtcccgatacggtcagtacaaccacatcttccggtttgaacttcaattttttcagcgcacccagtgcgtgggcagattccagtgcgggaatgattccttcaagtttggtcagttcataagcggcttctattgcttcgtcatcattgacagccaatacggtagcccgtctttgagcggcaagattggcgtgtatcggtccgattcccggatagtccagtccggcggagatagagtagggttcttcaatctgtccgtcttcgttctggataacgtaagtacgggctccatggataatgcccattttcccaagctgtatagtggcggcggtcattccggtttctattccttttcctcctgcttctgccagaatgatgcctacccgtccgtcattgatataatgataaatcgttccggcggcattgcttcctccacctacacaggctatcagataatcagggtgatcacgtccttctttctccataagttgttttttgatttcttcgctgattacggattgcaggcgtgccaccatgtcgggataaggatggggacctactgttgagccgatgatataataagtgtcggcaggatgacagcaccagtcgcggattgcttcgttggtcgcatctttcagtgtcatgttaccggaagtgactgggattacggtagctcccagcatcttcattttttcgacattgatgtgctggcgctcaacgtccgttttacccatatagacaatacattccatatccatcaaagcacatacggtagccgttgcaacgccgtgttgtccggctccggtttcagcgataatacgtttctttcccatgcggcgtgccagcaaaatctgtccgatagtattattgattttgtgggcacctgtatggttcaggtcttcccgtttcagatacattttgcaaccatacttttctgaaagtctgcgggcgagatagagtggggaagggcggcctacgtagtcacgcagcaactggtcaaactcctttttgaaatcttcgctttcgagcactccgaggtacgtattcttcagttcctctacacatttgtggagaatttccggaacataagcgccgccgaactctccgtagtaaccatcctgatcaactaaaaaacttttcataatcctatttttatttattattatttattcgattttcaaaaacgggcaaatagaaagagccctgtcgcaggttgcgacagggctctttcaaatttgttatatctttaatgaggtatatacatacgagcactgctcccttacgactgtcggagttgtaacgggcgccaccaccaatatgtatttactaacattgttctcattgtcttttgttatttatcggggacaaatatagacactttgtttgaaacaacaaacaaaatcttactttttttctttttcctcttcatttttctgatatagaacaattttctgcctgatctgttcttataaatattgaatatttaaacgaaaaacaattatgaaacagagaaaagtcttagtaggtattgctattgccatttttattatattattgctttattggttattggtagctgaagatatgaaaccttggctgtccgctatggttccttcagccttgcaacaattcattgcctgatcccgacaggtttcagataattggcgtatatttgcaaggttagtaactaataaccaaaataacaacaatagacagatatggaaaattttatctttcagaatcccgtaaagctgattatggggcatggaatgattgcccggttgagcaaagaaataccatccgacaaacgtatcatgataacttttggcggaggcagcgtgaaaaagaatggtgtgtatgatcaggtaaaagaagcgcttaaagaccattttacaatagagttttggggcatcgagcctaatccggccatcgaaacgcttcgcaaggcgattgctttgggcaaggagcagaaagtcgattatctattggctgtaggcggtggttctgtgattgatggtacgaaattgatttccgcaggtttgttatatgacggtgatgcatgggatttggtacttgccggacgtccggttaccaagactgtgccgctttctaccgtattgacacttcctgccacaggttcggaaatgaataacggagctgtcatctcccgtcacgaaactaaggaaaaatatcctttttattccaatttcccattgttctctattcttgatccggaagtaacctttactctacctcctcatcaggtggcgtgcggattggcggatacattcgttcatgtgatggaacaatacatgacagttgccggacaaagccgtgtgatggaccgttgggcggaaggtatcctgcaaactctggtagaaatagctccaaagattcgtgagaaccagcatgattatcagcttatggcagatttcatgctttctgcaacaatggcattgaatggcttcattgcaatgggagtgtctcaggactgggcgactcacatgatcggtcatgaaatcactgcattgcatggactgacacatgggcatacgctggtgattattctcccggcaactttacgtgtccttcgggaagcgaaaggagacaagttggtgcaatacggtgaaagagtatggggaattacttccggaacgaaagaagaacgcattgatgaagcaattgatcgtactgaagagtttttccgttcattgggcttgactactcgtctgcatgaagaaaatatcggtgaagaaaccgttttggaaattgaacgccggtttaatgaacgtggtgccaagtatggagaaaatgagaatgtgacaggagccgttgcccgtaaaatattggaggctgccctctgatcgcttcttttgacactgttttgaactaaataatagtcggttctatctttcattctcctccttcccgaaggaggagaatggagttactattgtgtactactgtttagttcattcctaaacagaaaggagtaaaactgtacaagtatgaattagtgtgtacagccatttacagttaattatttgatttttgggttatcggaagtctgagccaaaagcacgaaccttctccttctttagaatctgctccgatagtgccgcctaagcgctctacgatcacccggcagatagccagaccgagtcccgtaccttttgcgaatgtattcagcttgacgaaacgttcgaatacctcgtttattttatcctccggaatcccaatgcccgtgtcttttacatagaagtagatttcatcttttgcttcgtcaatccgatatcccatttggatggaacctttcggagtgaacttcatcgcattgtttgtgaagttgatgattacttgcgaaagacgtacgcggtctgtgttgagaatacattcttccgctttctccgtgaaggtgatcgccacgtcgggagaagtgtttttctcttgcatttgcctgcaaataccttccatcagatcattgatatcggtaggggcgaggctaaattccatcgttccggcttcgattttggaaagatcgagaatatcatctatcaattgcagtaacaactcattgttactggacactatcttcatgtattcctgtttctcttcctcttcacccgtttggcaaatcatgtcagagaatccaataatcgcattcaacggagtacgtatctcgtgactcatgttggcaaggaaagctgatttcagacggtttgattcttctgctttttcttttgcttcctgtagcatcttgtccattttcaccttttcggtgatgtcttcgaagcgcaacagaccgccgatgatttctattccttcattatcataaaccggagtagctgtcacttcaaagtctacctgatctatctggatagtatggcgtatgatttttccttgttcaatcgctttctgaaaggcgcattgttcgcatggagtatcccggagtgcacttgttttgtagcagatttgtcccggtgtataatgccttcctttcacgaggctggcaatttgcgtcgtttcttcccattgtaccagatagtttttgtcgatataaatgagcccgaagttgacgctcttcaaagctagcttttgtttgttcagcgctttttccagttcttctttggcggcaatcagttctcgttcgtaagtctttagccgggtgatgtcccatcgggtcactaacagccattttttcttttccttccatttgataatcgattttacggcaattgtatcatgtactgctccgtccactgtgctgtagctttcttctgcccggtatatcttgtctgcctgcacaagtgattcatccacatcacggtattttctgccccgttcttctccatagatttcgtagtctgtgcatcctattgcttcttcccgcttaatgccggattgcagttcggattctttgttccagtaatagtatcggaaactattctggatatcttttaccataatagggaaagggaggttatcgagtatatcgaataaagaatgatagtaatcctgttcttttcctatattctttttaagttgtcgtagtctgtataataaaaagcagatgatcaggagtaaaaagcctattagtaaataataataactccaatgctggtctgtaatccatataacggatagtatattgtttgccataatttatgtttgtactaaatctgtggtaaatatatgcattttttgtaattcacaaaggaaatttctgaaatatattgtttatcagccttataaaactcttctgaaaagaatacctttactgattagtagaactttggtgccttctatttccggttcggttttaaaatgtttttgatggaacgtattttcgtaaagagtaagaatgtattaaaatattaaatgatgtcccatgaaccaaaaacaattctaatttgtttttataacggcaaagtattttttaattttgctcctccaaaataaatctttgatacattcaggataaaacaatcattttatttttagcttatgttgataaccattatcattctcgttctttcggctatcttttttgtaaacggtaagatacgttcggatcttgtggcactatgtgcgttagtagctttgcttatctttcagatattaacacccgacgaagccctttccggtttctccaattcggtagtcattatgatgatcggattgtttgtcgtgggcggagctatttttcagacaggactggcaaaaatgataagttcgcgtatccttaaacttgctggaaacagtgaaattcgcctgttcttccttgttatgttggtcacttccgctatcggtgcgtttgtcagtaataccggaacggtggcactgatgcttcccattgtggtcagtctggcgatgagcgccaaaatgaatccgagtcggttgctgatgccgttggcctttgccagtagtatgggaggtatgatgacgctgattggtacaccgcccaaccttgtcatacaaaacacattgacttccgcaggcttcgaaccgctttctttctttactttcctgcctgtaggtttggtgagtgtggctgtcggtacgctggttctgatgccgcttagtaagtggtttctttctaaaaaagggcagaaagatgataacagccgttcgggtaagtcgctgaaacagttggtgaatgaatatggtctttccagtaatctgttccgtatgcaggtgattaaagactcccgccttttgggaaagaccatcctcgatctggatattcgtcgtaaatatggacttaatattatggaagtccgtcgtggagatgcttcgcagcaccgttttctgaagactattactcagaaacttgccgaaccggatactatgctggaagcggaagatattctgtatgtgacgggagaatttgataaagtgcagcaatttgccgaagattatctgctggatatattggatgatcatgctacggaagagacgaaaagcactactaattcgcttgatttttatgatatcggtattgccgaaattgtattgatgcctgcttccaatctagtcaatcagaccattaaagagtccggattccgtgataagtttaatgtgaatgtattaggtatccgtcgtaaaaaggaatatctgttgcaggatttgggaaatgagcggattcatagtggtgatgtgcttttagtgcagggaacttggagtaatattgcccggcttagtaaggaagattcggattgggtagtgttgggacagcctttggcagaagcggctaaagtaactttggactataaagcacctgttgctgctgctatcatggtattgatggtagcaatgatggtattcgattttattccggttgcacctgttacggccgttatgatagcaggtatcctgatggttttgacgggatgtttccgtaatgtggaagcagcttacaaaacaatcaactgggaaagtattgtattgattgcggctatgcttcctatgtctttggcattagagaaaacaggcgcttcggagtacatctccaatactttggtaagtgggcttggatcttacggaccgatagcattgatggctggtatttattttacgacatcattgatgactatgtttatcagtaataccgctactgctgtcttgcttgcaccgattgctttgcaaagtgctatgcagatcggagttagtccggttcctttcctgtttgccgtgacggtgggtgcaagtatgtgtttcgcttctccgttctctacaccgcctaatgcgctggtgatgcctgccggacaatatacttttatggattatataaaagtaggattaccgttgcagattatcatgggaattgtgatgatattggtgctgcctctgattttcccattctgacagatagaagggaattagtataacgttttagcaactgccttgtagtctgatatcagattacagggcagttgttattatatcaatagatgattgcttttatcataatgttcggtgataagtctttcttctgtcatttgtttgtagaaagatccgatttgctttcctgcctgttttttaataatcttctgttagcttggaaaggtggttgaattatcgcaaatatacggttgatttgcatgaaatgaccgtatgattcggtgaaaaacaccgtattgtttgtgaaaaagatgcggatgaagtaaccaaaagatgcagatggtgtcactaaaaggtaggtatgatgtaagtaaaccattgctatagtgtcattataccgataaaactgtctttatttaatacttttgaccttctctgttttctatttcgctctttggaaagtttagatggctaatgttgaaaataaacagaactgatgaaaatataatcatgtagatatataagtagagtataatatattaataagtgctgaattggatgtaaatgctgattttttgatatatgctagttgcccaacaatcgcgaaaaaatatcaatagtagtatgaccggctaaagaagcccttcttgatgcattacgaattacaaactgtcaaaaacatacttatctttcagaatgtcattttatacatgaagaaagatggaatttatagaaaaaggctcctgatgcaaatgacttatcattcggatatcaggagccttttatctatttattgaacctttggtgcgacaggtgtattcatcttctgagtgtacaggctgtcgataattccgtcggacagtccgatggtaggtacaatgattccggtagctttcacattcatagctacttccagaaatatctccgcagccggaacgatgacatcagcccgatcaggttttagcttatactgtttgatacgttgctcggcaggaagagcttgcaatgcttcgtaaatttcacgtagcgattcgacgggtaggagagaagcctttttgtctttcttgtctgccagacggaaaagcttattgatgtttcctcccgaaccgatgatgctggtaggcgcgtattccgcggcaagccctatgaggtcggtgcgtaaagcctctttttcttcttctttcaccatgccgctgagcatgcgaaccgttccgatattgtatgaacgggaatttttcagttctccgttactgatcagattaatctcggtgctgccaccgccgacatctacatacaggtagttttgtccggaagcaaaaagttgctcgatatggttgtcatatacaatgtgtgcttcttcttgtccgtcgatgatatctacgcggataccagttttcctggctatttgtcgggcgatgtcctttccgttgcgtgcgtcacgcatggcggacgtagcacaggcacggtaatctactacgtcatatatcttcatcaactgtttgtaggctttcatcagccggatcagtttcttttctttttcagcagaaataactcccatggtaaaagcatcttctcccagtcgtaagggaatgcggatgagttgtaccttgctcattaattcgggagcgttttcttcgtttacgcattttatcaatagccgcacggcattcgaacctatgtcgatagctgcataattaactttcttcatacttatcataatgtattcttgtattttctatataattcttcttgcgaacggaaaacgacagtggctgtctctgcttcggcaagggcaggagtgaagtctttgcagagtgtggaaggtcggttttcccaaggtcggttttctccggtcccgtctacgatacgtcctttggccgtatcccgatatccgtagcagacaattcgttttaagtctgcctgtatttctttgtcgtacaccggagccagtacttcgatccggttatcaaggttgcggggcatccagtcggcagaaccgatataatatttttcttctccgccattggcaaagataaagatacgggagtgttcaagatatcggtcgataataccgttgatatggatattttcactgatacctgcgatgcctgtcaccagcgaacagttgccgcgtactaccagttccacttgaactccggccgtcgaggcttcgtagagtttttctataagcgcacggtcggtaatatggtttacttttgccagaatataggcttctttcccttgttccttgttctttatttccttgctgatgagagcaatcagacgtttgcgcatatcgttgggtgaaaccagtaattctttgaaattgacgggagtgtatggtttctcaataaagtcgaaaacggcattcacttctcgtaccagcggacgatgggcggtcatgatggtataatcggtatacatacgtgcgtttccttcatgaaagtttcctgtgctgatgcaggcaatgtctccgtgacgggtaccgatatgtaccagtttggaatgaatcttcagtccctccactccgaagataacgtggatgcctgcgtcctgcattcttttgctccagttgatgttggatgcttcgtcgaaacgtgccagtagttcgatgaccaccgttactttcttcccgtttttggctgcgcagatcagtgctttgatcacttttgattctttagcgagccggtaaagtgtcatcttgatactttttacttctttgctgatggctgcttcacgaagtacgcggatgaaagtatcgaagctatggaatggataatgcagggagcggtccttctgacgaatcaatgtgagcaggctttctttgccgtttagttcgggcttgaaaaccggttcccagacgggatactttaagtcgtagcgaccgcacaccggaaatttcatcaagtctttgaagttatgatagcgtcctcctgccacacgggtgtcgtttttatccacattcagccggtcaactaatcttttcagtaaatctttgggaatctgttcgtcataaacgaatcgaatcggttctcctctcttccggcttttcactccttttgaaatcttctgaagtacgcctgtccgcaggtcgctgtctatctccatttccgcgtctttggtgaatttaaaggtatatgcctcgtaatccgtatatttcatgccgacaaaaatcaacggcagacaatagcggatcacatcatcgagaaacatcagatatgttttcccctccgagtccggcaattggataaaacgaccgtattcttcggtgggcaattcgatcactgcataatctttctcttttatttttcctgtttcgtctttacgaagcaggcggatggcgagataaatatcttcgtcagtctggtcgtccagcggtcgggctccgttgaggaaaagaggggtggtggagccattcagtttattgcgatagaaggaggtgataaatgtcttttggtcatccgtcatttcggtgtctttgatgacgcagatgttttccttcttcagttcttccatgatggaagcgaaagtttcttcaaattgttcgtagaagcggttgtgtagtttgcttatctgcttcagtgtgcgtgtagccgtttcttgttctttctgtatgtttttatctgcatattcgatgatccggttcagcgtagctacgcggacgcggaaaaactcatccagattattggaatagatgccaagaaaagtcaggcgttccagaagaggtacttccggacgggcagcttcgagcaggatacgctgattgaagtacatccagctgatgtcacgttctacataagggcacttcttttttgtttcgcttgatttcatgatgaaaaacctgtttattaattttctgcaaaattatctaagtgaggtgtaatggctataacgattttgttacgaacttattacaatctacgtttgttatttttatatgtgaatagaaacacttatattcgcaaaagtattgaaatggacttcgttaaaaaatatagaatatatgaaaacaatgaattactctctgattcgcattttgtttgcgcttgtcataggtctggtgttggtactttggccgaatacagcagctagttatattgtcattacgataggagtggcttttttgattcccggtgtcatcagtctttttagctttttcggacggaaaagatcggaacatgaaccggctccccgttttcctattgagggaatcggcagtttgttattcggactttggctgattgtgatgcctgagttttttgcagacgtcctgatgttccttttgggctttatcctgatcatgggaggtgtgcagcagattgcctctttgtcgatggcccgtcgttggacacctgttccggggattttctatctggtgccttcattgattcttatcgcaggtgttattgcgctgttcaatccgacgggagtacgtaatactgctttcattattatcggtatcagtagcttggtttattctctgtccgaactgatcaactggtttaagtttgcgcgccgtcgtcctaagactccggttacgcctcacgatgaggatattgaggatgctaagattatagaataaaaaaagaagaggactaccgtcacggtacccctcccctgcaaacttaaaacaaccaacaaaagaaatagataatttctatcttaatgctgaatgaagatattctccattcagcatttcttttttatcttacaaacaacagttctctgtatttcggcagtgtccacatctggttgtctacgatcagttccagcttgtcaatgtggtaacgaatctcttccagtgccggaacgattgtatcgtggtaagcgatcgctttttcgcgttcgctttcgatcttgttcgccacttttcgtgcttcaatcattgcatctacgtgttctttgatgaaggcggtgcggtcggcgatttcttcgatcagttccagattcttggcagatagtctggctgctttatctgccggaaataaggactgcattttatagacattattaatcagatccgtctgatattgagtagcgaccggaataatgtggttcattgccaggtcgcctaatacgcgggcttcaatctgaatctttttcgtgtaagtttcccattttacttcgttgcgggcttccagttcctttttcgtcatcacaccgattgcttcgaacatagcaattgtctccggtttcagatagttgtcgaagataacgggaacacttgtttcacagtccagacctcgacgggcggcttctactttccattcgtcgctgtaaccgttgccatcgaagtggatagccttacattctttgatatatccgcgaattacttcaaggatagcggaaactttcggttctcccttttcgatcagagcgtctacatcctttttgaatttcatcagctgttctgctacggcagcgtttaatgcaatcatggcacttgcacagttggcctcagagcctacggcacggaactcaaaccggtttccggtgaaagcgaaaggagaggtgcggttgcggtctgtattatcaatcagcaattcggggatttggggaatatccagcttcattccctgttttccgctaaggttgatcagatcgtctttggtactgttctcaatatgatccaatacctgtgacaactgtttgccgaggaaagaagaaatgatagcgggaggtgcttcattggctcccaggcgatgagcgttggtagcgctggaaatagaagctttcagtaatccgttgtgacggtaaactgccatcagcgtattcactacaaatgtgacaaagcgcaggttatcttccggcgtcttgcccggtcccatcaacaggatacctgtatccgttcccagtgaccagttattgtgcttgccggaaccgttgacacccttgaacggcttttcatgaagcaatacacggaaaccgtgacggcggctgactttacgcatcaacgacatgatcagtaggttatggtcatttgccaggttacattcttcgaagataggagctaattcgaattgattcggagctacctcgttatgacgggtctttacaggaatacccagtttcaacgcttcaatttcaaggtctttcataaatgcggccacacgggtagggatggcaccgaaatagtggtcttccaactgctggttcttggcactgtcatgtcccatcaatgtgcgtcctgtcataagtaagtccggacgtgcggcatacaaaccttcatctaccagaaagtattcctgttcccatcccagataggcaacgaccttctttacctcaggattgaaatagtggcagacggcggttgcggctttatctacggcacgcagagctttcagtaacggtgctttataatcaagggcttcacctgtatatgcgataaatacagtcgggatgcaaagcgtatcatctacgataaatgcgggtgatgatgggtcccatgcgctatatccgcgtgcttcgaaagtattacggataccgccgttcgggaaagaagaagcatccggctcctgctgtaccagcagtttgcctgtgaactcttccatcatgcctcccttgccgtcatgttcgacgaaagcgtcatgcttttctgccgtaccttcggtgagcggtgcaaaccagtgagtataatgagtgacacccatttcgacagcccattttttcattccggcagctacttcatcagcgatgctgcggtctagcggggcaccattgtcaatagcgtcaatcagtgcgttgtataccttgcttggaaggtacttgaacattttttccttgttgaacacatacttaccgaagtattccgaagggcgttcggcaggtgttgctacttcaaccgctttcttcttgaaagctgtctctacgactctgaatcttagttttgacataatacctaatttgatttgttgttaaatatgttagagtaaaaattccttttttagcttagttataagcagattctccgtgttcgtagatgtcgagaccttcttcttcgacacgtgccggaacgcgaagtccgtgaatcttgtcgagtactttgaagataatgaatcccatacctgccgcccagactccgacaacaaccgcaccgaaaagctgggcacccaaaaagccggctccatgtccgtagaacaacccttcactggtagaaaacaatcctgtgagcactgttcccaagaaaccacaaaccccgtgtacggaagaagcaccgacaggatcgtcaatcttcaataccttgtcaataaagtcgactgcaaatatcatgactacaccacaaatggcaccgattaataccgctcctgagggagctacagcgtcacatccggctgtgatacctaccaaacctgccaaaacaccattcagtgtcagtgataaagacggtttgccatatttcatccagctcatcgccagtgcaaagaagccaccggcacaagccgccagatttgttgtcagaaatacatgtgagatggccattgcatccgcttcggtacttgctgccaactgtgatccggggttgaatccgaaccatccgaaccaaaggataaatacacccagtgcggcaactgtcaggttgtgtcccggaatagctcttgacttaccgtctttgccatatttaccgatacggggaccaagaatagcagcgcctaccaaagcaatccaaccaccaacggagtggacaatcgttgaacctgcaaagtcatggaatgtcgttccgaaaagattcatcatgaacgaaccttcttctccgttcatcagccagccgccaccccatgtccagtgaccggaaattgggtaaattagtacactgataaagatagtatagaccagatacatggagaacttggtgcgttccgccatcgctcccgatacaatcgtggctgccgttgcgcagaatactgtctgaaaaaccagaaatccttctctgggtaaatcactgtcgaggaatgacagatcaaagaagtgtggcattccgatgagacctcccgcaccaaacatcagaccgaaaccgatgaaccagtagagcaaggaaccaaacatgaaatccacaaagttcttcatcaaaatgttggcggtattcttgactctggtaaaacccgcctcaaccaatgcaaaccccggctgcataaaaaatacgagcattgccgcaagcagcatccagactgtattcaatcctaatgccagttccccgattgtatcgggagttgtttcggcagaagcagtggcggtttcagcaatttcaggtgtagttttgacttcagtaattgtctccgtagttgtcataaaagtatctgcatcaactgcttcctgtgcaaaagcactggttgcgaaacagcagaaaatgaacatagcagtggctatccacagctttgtgaagctgtgtctcttatatgttttatccataatgattatcttatttaatacctgtttttataatattatcatccgaaaggaaatctggccccggcaccttgccggttgccggttatcgttcctgttcggcgttatagagagcgatgtcgccacgttcggcggtgcggatgcggatggcgtcctcgataggaatgacgaaaatgcgtccgtcaccgatctctccggtttgtgcggctttgatgatagcctgtacggtcttttctgcatttttgtcgcgtactacaatagaaaccagaatacgttcgatggtgctggtatcatataccactccacgatagatacgtccttgccgtgctttaccgatccctcttacatcgtagtaagagaaccattcaatgtccgcttcgagcagagcgtctttcacgtcctcgaatttggttttacggatgatagcttcaatctttttcatataccttaaatattagtgttgacctgtaaaaagaagaggtatagggaggtggcagccatcgcaggttaccatacaacaaaccgataaaatctaaactctaactaccttcctgttccctatacgctctttgactatataaactctctctctcttaaaaacttaatccgaatgtgaagtaagcgccttccgtacgtggatttactgatactttggcaaatgccggaaccgagaatgaatcagtaaccctgatctccttgacagctccgagactgatgtcggaaacgcagaacccacttgtgtatccattataaaaagtcgtctcccaaggtaccattcctacatctactgtccagtcaagtcctccaaggctgaacggtgcactaagtgcgaggtaggaagaataagcccttttcccgttttctttaactccgtcggcacctgcaaagttcgtgtaccagttgattgccagcggaccaaaatcatatcctacctgtgcctcaaatacatgagcggttgaatgagcgccatatttgaaatacttgttggtaggtacctgagtgttgaaccagtaatccgttaccgagatgctgaaaccaccggttgaataaccgagagtcaaatcgaactctttagtatccgatgactcaaaccctaccgatccccatgctccgagtgaaagtcctttgtaagagattcctaatgaaggctgaatgctgactccgcctaaatcctgaccacgccagatataaccacttaccaagtctgctcctacggaggcttctactttatcctgcgccatcatattggatggcacaaggccgatcagtaataacgctgctgctatgcccctcaattttttgttaatcgtcgttttcatcgtctttttacctttaatagttagaaaaatgtggatgtacggtccagtgttatatagtagcgcgcaaaatactatcaaagccagttctttattcttctcattgcttccatacaatcattgtgatcgccgaatgctgtcagtcggatatatccctcaccgctggggccgaaacctacaccgggggttcctactacattggcttcatacaacatctgttcgaagaatcgccaggaagagagcccgttcggggttttcacccataagtatggagcattgacgcctccgtatactttcaatccggtagcttccagtccttccttcatgatcttcgcattgctcatataatagttaatcgtttctttaatctgtgctttgccttctgtactgtagacggcttccgctgcacgttgtgtgatgtacgaagtgccgttgaatttagtgcactggcggcggttccataatttgttgagtggaatccggtcgccttccagtgtggcagctgtcagttctttcgggactacggtatatccgcaacgtactccggtgaaaccggctgtctttgagaaactgcggaactcaatagcacatttcttggctcctttgatttcgtatatggagtgggggacatccgcatcctgaatataggcttcgtatgcggcatcgaacaaaatcagtgtatcatttgccaatgcatagtctacccacttttttagttccggtttggtcagtgtcgtccctgtcggattgttcgggtagcagaggtaaacaatgtctatccgtttgtcgggaatctccggaatgaagtcattctcacttgtacaaggcatataagtcacattgctccatttgcctgttccttcttccagcactccggcacgtccgcacatgacgttactgtcaatatataccgggtaaatagggtctgttacaccgacactattgtcgtggcgaaggatatcgccgatatttccggtatcacttttggctccgtcgttgacgaatatttctgatggtgagaaatgaatgccacgtggagcgaaatcattctttataatagcttcaatcagaaaatcgtacccctgctcaggaccatatccgcgaaatgtatctttacttgccagctcttccactgctttgtgcatagcctcgatacatgctttgggaagcggctgagtgacatctccgatacctaaccgaataatatcctgcttcggatgcgttattttgaatgtatttaccttcttcgctatatccgagaacaaatagctccccggtaatttcaaaaaatgttcgtttactaatgccatattgttattgttttaagtttctgcaaaacctgttacctattacctaatacttattacctatccctccatctccccatcaaaaactttagttgccggtcctgtcattaatatgtgtcccgttgcttcttcccactcgatggtgacggttcccccatccattattatatcacattttcttcctgccaatccatggagaacagcggctacagccgtggcacaagcgcctgttccacaggcctgggtgattcctgaacctctttcccaaactctcatccgaatggtgtctttacctacgatctgagcaaactctacatttgtcctgtccggaaagagatgataattttctaactgcggaccaatttccggcagattgatttgggtaatatcttctacaaaagttaccagatgcgggtttcccattgatacccgggtagactgaaaaggaaattgatcgccgaaatctaccgcttccgtttccagaggactacccatatctacagtgactgccgtcacctttcctccttctacatgtaatttcagaaccttaatgcccgaacgggtgtcaagcgtgatttcctttttggcagttaatccgtattcgtatacatacttgcctacacaacggcttccattgccacacatcattgcttccgaaccatctgcattaaatatacgcatactgaaatctgctttgtcagaactgccaatcaatataagtccgtcacttccaattcccgtatgaaacttgctccattcgattgctttcttttcaggggctgctatcggatatcgggtagtatctacatatatgtagtcattacctgctccatgcatttttgtgaacttaatcttggttgtcattttgttctttattaattggttgttgtatccttttgttttattacaatgcaaagatatgactttttgatttaacttttgatgaaaagatgtctaatctctatttattttatacgatcttacaatcgcgggaaataaagccatgttttgttataaattgaaattatgcatacctttatattaataaactgttatttgcttgatttgttttgcatatccttccataatatatgaagaatatttggggtaaatcagtccttgtattcgatctaaaatgtgaattttcgcttttacaataggtcgatatgctagtgattttcgcttttatatatcatattgcttgtttgcagttttgcagaacctttttgttatagcattgtttagtcactaataaatataataatgtagcaatatggatatagagaaacaattggaagttgcggcgcagagcgatcatttggtattgattgtgttttatgccgactggtcacctcattatgaatggatagggcctgtgctccgtacttatgaacggagagtcattgaattgattaacgtgaatatcgaggaaaataaaactgtagccgattctcataatatagatacggtgcctgcgttccttctgttgcataaaggacatgaattgtggaggcaggtaggagagttgaccataggagagttgaaagaggtattggaagattttaaataagtcctgtttgaattttatgtaagaagcaccattatacagcaaataaatatgtataatggtgcttcttgtatctatcgaatatttgcaaaaagtttctgtcggctttttacattttctgagagtaactattttagtatttcctgtgccacagtcggctcgttggtcgtaatgaaatccaccttttggtctatgagccacttcatgtcttctgctttatctacagtccatacattgactttcagtccgagatcatgggcttctttgatccattcgggatgtttcttgattactcccatgtgatagtcgagtccggctgcaccgaggtctttcagctctttgggagatagctcgccgttgagatagaataccggagttccggcaggtgccaggcggataaactctttcatggcgtgcagtgagaaagtgatatattccatacggttttccagtcccagctttgttaccaaggcaagaatttcctgtacggctttcgtttcacgctttttgctgttaagtgcttttagttccaatataagtttggtattgcattttttaccggcttccagatactgttccaggctgggcaggttctctccgttcgatagtttcaatcctgtaagagcgtcacctttggaatactccatgtatttcatcttatagacagggtcatgattgataaccagtttattgtctttggtaagccatacatcaaattcggagccatagcaatggatagaatcggctttttgaagtgctgtgatactattttgcgcagaacctgctgttttccagtagccacgatgggcgataacttgcgacttttgcgcttgggcactagctactgaaatgataagggcaaccattagaataattctttttatcttcattgatagtacatttaaaaagtttatgagtccaaaattataaaaaataaaacacagatcagcctgttattatgctaatctgcgttaattgacagctttttatgcatagaagtctatactttttattcctgactttacaaactgatgaatatatattcaaagatatgagtttatttcagacatctaaaatttttcaacaaatttattttacctcttcggcataggcttcttcatgcactcctctcactgctctgccgcttggttcattcaggttacggaaagctacatcccatgccagcgcttctgctgtagagcaggccacacttggtacgcttggtacgctgcgggctgcgctttcactcggaaaatgctcttcaaagatactccggtagtaatattcttccttgttgagcggagtgttaatcgggaaacgttcggcagcgtgttccatctgttcatcactgacggcagccgctgtaatctctcttaaggtatcaatccacgaatatcccacaccatcactgaactgctctttttgtctccatgctacgctttccggtagcatatcggcaaaagcttcacgtacaattcgtttctcaatctcctttctggggcacattttagcttttggattcaacgccatcgctacatccagaaattccttgtccagaaatgggacacgtccctctacaccccaggctgataaactcttattggcacgaaggcaatcatacatatgcagttttgataacttacgtaccgtttcctcatggaaatctttcggagtgggagctttgtgaaagtaaagataaccgccgaaaacttcatcggcaccttcaccactcaataccattttgatccccatcgatttgatcacacgtgccagtaaatacatgggagtggaggcacgtaccgtagtcacatcatacgtctcgataaaatagataacatcccgaatagcatccagcccttcctgaaccgtataattgatttcatgatgaaccgtaccgatatattctgccacttcacgtgcctttatcaaatcgggcgcccccttcagaccgatggcaaaagaatgtagttgaggccaccaggcgtcacttgctccgtctgtttcaatacgttttgctgcatattttttggcgatagctgaaatcacagaactgtccagaccacctgaaagaagtactccatagggaacgtcactcatcagctggcgatgaacggcatcttccaatgcttcttttacatcactgactttggcatcattgtcttttacagactcatagtctgtccattcgcgtgtataccaacgcttcattttgccttctttactgtaaaagtaatgtcccggaagaaatggttcgtactcattacagaatccttcgagtgctttcagttcactgccgaagtagattttgccatccttgtcttttcctatatataaaggtatgactccgataggatcacgtgcaatgaggaactcgtctttttcttcatcataaagtacaaaggcgaaaattccgctgatctcttccagaaagtggatgcctttatctttataaagggcaagaatcacttcacagtcgcttccggtctgaaaatcatattgtccggcatagcgggcgcggatatcccgatggttgtagatttcaccgttcacggcgagcgcttgtttccggtcgggggagtataagggctgtcctccgctttgcgggtcaactatcgagaggcgttcgtgtgccagaatggcgcttccacctacgtagataccgctccagtccggtccgcgatgacggattttctgtgccattttcagtgctttgtctcttagctctttggtttgagtttttatgttgagtatacctgctattccacacataactttgagtatttggaagttaatataatttgttgattctctgttttttaaaagtcggttcgttactatttattcgttttccctggcttttcctttcgtttgacctgggtcatcttttagttcaacctaggttgttgtttcgttcaacctaggtcaaacgaataaataatagtctataaacttcatggtgttccttgctgtaagggttacttcaccaaatagtgatctatgtccgcagcagcctttcgtcctcctgccatcgcccgtactacgaggcttgctccggtagctgcatctccggcaaggaatacgttttctgcaaatttcggttgttccggtttcaggaatcccatggccagcagcaccatatctgcttcgattacttctttcttccctgtgaggttcatggtcggacgtccgccatctgttgccggtgtccattctacttcttccacctcgacgccggttactttaccgttcttacccaaaaactgattggaagtcaggcaccagcgacgggtacaaccttcttcatggctggaggtcgttttgaaaactaccggccattgcggccagggcgtagaaggattgtggccgacgggaggtttgggcataatttcaatttgcgtgacgctggttgctccctgtcgtacactggttccgatacagtccgaaccggtgtctccaccgccgatcacaagcacttttttgcctttggcattcaccagtttgtctttggggaaagtttgtccttccagaatcctgttctgttgcgccagcatttccagtgcgaaatggattcctttcaactcccgtcccggaatgcttaaatcacgggcagtcggtgtacccgtgcaaatgcaatatgcatcgaatccttccggcaaatggttaacgtctatttctactcccatttcaaactgaataccttctgcggcaagtattttcatgcggcggtcgattacgtttttgtccagtttgaagtttggaataccgaaacgtaataatcctcccgcagcttcatctttatcgaataacgttacggtgtatccttttagattcagttggttggcaactaccaatccggccggaccggcaccgacaactgctacttttttgccgtttctttggggatgctgcacctgtatatatccttcacggaaggcggcttctacaatggcagcttcattttcacggatagtcaccggttggtcacaggatagtttcagtacacaggatttctcacagagggcagggcagatacgtcctgtaaattccggaaagtcgcaagtggatgacagcacttcatacgcttctttccattttcctttgaataaagcgtcctgccattccggctgtttattgcctattggacaagcccagtgacaaaaaggtactccgcaatccatacaccgtgatgcctgtaatttacggctgttcgtattcaatgtttgttctacctgactatagtcagtgatgcgctcgctaacggggcggtatcccgcctcttgccgaggtatatttaaaaaagctttaggatctcccatcttgttaagtaataagtattaggtaataggtattaagcaataagtattaactatatggattaaagatgtttgaagctacggttaatacctaatacttaatacctaatacttgaattaatagtctctttgcatatctgctattttttgctgtaactttctcatctgctcttcctgtagtacttttttgtattcaataggtactatctggataaactgatctacgtaatggttccagtcatcgagcatggtacgtgccagtttcgaaccggtgtacaggtagtgctgacgaatcagttcgtgcagttctttgcggtaaccggcttcttcgatcagtgacagttcaaccatttccatgttgcagaagtagtcaaaattgccgtctttgttccatacgtaagccacaccgccactcataccggcggcaaaatttcgtccggtttgccccagaaccactacacggcctccggtcatatattcgcaacagtggtcgcctacaccttccactacggcaacagctcctgagttgcgcacggcaaaacgttcgcctacgcggccattgatataaacttcaccgctggttgcaccatagagcagggtgttgcctgcaatcgtgttcttttcggcttcgaagttgctgcggataggcggtaatacggcaatgcgtccgccactcaatcctttacccagataatcattcgcttcaccttccagcttgaaattgactcccggtacgaggaaggcaccgaacgactgtcccgcagagcctttgaatttcacattcaaggtatgttccggcagtcccttttctccgtgttttttggcaatgacaccggagagcatggcacctgtcgcacggtccgtattggcaattgtgtattccaatgaaacttctttttcgtgttctatcgcttcttgggcagcatcaatgattgccacatccttcactgtagaaataccatgatcctgatcgatgacgtgacggatggctgcactgttatccacgcgtgccagtagcttggtgaagtcaatcagagcgtgcttcggattcggatcgttttcgtcggatttgcgttcaatcaagtccgtgcgtccgataatatcatccattttggtgaatcccatttccgccagatattcacggacttcctgtgccaggaaggtgaaaaagttgataagatattcgctgcgcccatgaaagcgtttgcgtaattcctcattctgcgtggctactcctaccggacaagtattctggtgacatttgcgcatcatcacacatcccagcacgatcagggcggaagtggcaaaaccatattcttcggcgcccattaatgccattatgataatgtcgcgtccggttttcaattggccatcggcttgtaggacgacttgtccccgcagaccgttcagaaccaaggtttgctgtgtctcgctcagtcccagttccggagaaatgccggcgtaacggatggatgaagcgggagaggctcccgtaccaccctcggcaccggagatgacaatcaaatccgcttttgcttttgccacgcctgcggcaatggtacctacgccactttctgctaccagtttgacactgattttggcttgtggattaacgtttttcaagtcaaatatcaattgcgccaaatcctcaatcgaataaatatcatgatggggaggaggagagatcagtgagattcccggaatggaatggcgtgttttggctatgacgtcgttcactttgaatcccggaagctgtccgccttcccctggtttagctccctgcgctatttttatttgtatctcatcggcattcaccagatattcggcggtgaccccgaagcgtccggaagctacctgtttgatggcacttcgcatggaagtaccgtccggcagcgggtggaagcgggaagcatcttcgccaccttcacccgtgttgctgcgtccgtgaatggtattcatggcaatcgccattgcttcatgagcttccttgctgatagatccgaaagacatggcacccgtcacaaaacgacggagaatattctctatcggttctacctgttcgatggatataggattgcgacggaatcctaagaagtcacgcaggaaaataggtttctccttattgtctaccaaatgagtgaactctttgaatttcttgtagctgcccaagcgggtggcaagttgcaatgtactgatggtttccgggttccacgcatgtttctctccgtcctttcggaaggcatacagtccgttgttctttaataatggaaaattgaaagttgaaaattgagagttgccgtgcggtgcttcattttccattttcaattctccattttccattccttcaactccttcatcgtggaaagcgattgcgtctcttgccacttcctccaggcggatacctccgatgggggaaccgagtccgccgaaataagccttgctcaactcttcgctgagtccgacagcttcgaaaatctttgcaccgcgataagagcggatagtggaaatccccatcttactcatgattttgaacagacctttgcagatagatttgatatagtttttctcagcggtagcatagtccagttgaatatctttctcttttaccagcttgtcgaggatggcaaatgccatatacgggttcagtgcactggctccaaaaccgagtagtaaagcggcgtgcattacttcacgcatttctccgctctctacaatcaatgctgtctgcacacgtttgccgacagatatcagatggtgatgcacggcacttactgccagtaatgaagggataacggcatgagttgcatccacgtcacggtcggtcagtacaatgtagtttgctccgtccgtaactgattcctccgccattttgcaaaggttgttcagtgattcctgtaatccggctttccctttggatacttcaaacagcatcggtagttttacagtcttaaagcccttgtagcggatattgcaaagaatatccagctgtgtattgcttaaaatcggatgattcagacgtaccattttacaatgactctcgctgggagtcaggatattcatgcctaccgctccgatatattccgtcaaagacattaccagttcttcgcgtagcgggtcgatcggcggattcgtaacctgtgcgaattgttggcggaaatagttgtagagtagctgtggtttatcggaaagtacagccagtggcgtatcattacccattgagtggatgggttcggcacccgcgctcgccattggcataatcagccgttcgatatcttcttttgaatagccgaaagtacggagcatccggtcatagttttctacgtgatgaggcactttacgaccgcttttcagttcatccagttcgatacggttagtcgatagccatgtacggtaaggcttcgcttcggccagttgtttcttcaattcgccgtcatagtagatttctcctttctctgtatcgatcaatagaatcttgcccggttgcaggcgccctttttccttgatatctcccggttcaaagtccattacgcccacttcggatgccactaccatcgtatcgtttttagtgatcagatagcgggcagggcgcaggccgttacggtcgagcataccacctgcaaatcgtccgtcgctgaaaagcaaggctgccggtccgtcccaaggttccatcaggatagaatggtattcatagaatgctttcaggtcttcactgatcggattcttctcgttgaaagattccggtacgagcatagccattgcatgaggcagacttaatcctgacatgaccagaaattccagcacattgtccagagaagcactgtcgctcatacccggctgtatgatcgggcgtatttctttgatatctcccagcataggagtggagagtacgctttcacgggcttccatccatccgcggttgccacgaatggtattgatttcaccgttgtgcgccagcaggcggaaaggttgtgccagtccccatgtcggaaaagtgttggtgctgaaacgggagtgtaccagagccaagccgctggtgaagtagctattcgtcagatcaggatagtagttgcgtagctgcaatgacgagagcatacctttatatataatacttttggtcgagagcgaaacgacataaaaatcgtttctcgtcggaatagctgacaatctgactttattctctatccgtttgcgaatcagatacagtttgcggtcggcggtttccgtttccgtaaaaccggtaataaagacctgcttgatatccggttcgttagccagagccgcttcacctagaatttccggacaggtgggtacattgcgcagatgcatcaatgtaagtccctctttttctatttcttcaataatgatactaaaaatagctgcctgatctttctcgtttttcggtagaaaaagcagaccggtgccgtaccgtcccttttcgggtacggggatgccttgcagtaaaataaactcatgtggaatctgtaacataatacctgcaccgtcgccggttttgttatccgccccctcagcgccacggtgacgcatattctctaatacctttaaagccgactcaacaatgtcatgtgacttttctccgtgaatgttcaccagcataccaaccccgcaggcatcgtgttcatatgccgcgtcatacaagcccatttgtccaggctgtcgttggtaggggaattttcctgttgcgttgttaaaaagttcttgtttcttcattctttctagctttattgtatgataatacctatttgatgtatcaaattgttcggcaaaattaagaatttaatttcataatgatagcgtattgtttgttttgtgtgacacaaaataagaacctctttctttattcttttaatttgtaatcaaaatgctctgatttgcttataatttatcagtctgtccggttttattttatcctgattgtaatttgtttctttttgagcttaaaataatatattatttaacgttttgatgtgtttacaacttttttatgtgcttatgtcaaataaatattgaaaaagttatctttgtgtcatttggaatgtgtatatttgcacccgaaataaaaatatcataatatgtgtggaatagtaggctatattggtaaaagaaaagcctaccccatccttattaaagggctgaagcgactggagtatcgtggatatgacagtgcaggggtagcattgatcagtgataaccaacagttaaatgtgtacaagacgaaagggaaagtctccgaacttgaaaatttcgtcacacaaaaagatatttccggtacagtcggaattgcccatacccgttgggctactcacggggaaccttgttccgttaatgctcatcctcattactcttcttccgaaaaactcgctctcattcataacggtatcattgaaaattacgccgttctcaaagaaaaactccaagccaaaggctacgtctttaaaagtagtaccgataccgaggtgctcgttcaattaatcgaatatatgaaagttaccaatcgggtcgatctgcttactgccgttcagttggctttgaatgaagtgattggtgcttatgcgattgcgattcttgataaagagcatccggaagaaatcattgcggcccgcaaaagcagtccgctggtggtaggtattggtgaagatgagtttttccttgcttcggatgccacaccgattgtagaatatacagataaggtggtatacctcgaagatggtgagatagcggtgatcaatcggggaaaagagctgaaggtagtcgaccttagtaatgtggaaatgactcccgaagtgaaaaaagtagaattgaagcttggccagctggaaaaaggaggttatccgcatttcatgttgaaggagatttttgagcagccggactgtattcacgattgtatgcgtggacgtatcaatgtggaagccaataacgtggtgctttcggcagtaatagactataaagaaaagttgctgaacgccaaacgctttattattgtggcttgcggtacttcgtggcatgcgggattgatcgggaagcatctgattgaaagtttttgccgtattccggtagaagtggagtatgcctccgaatttcgttaccgtgatccggtgatcgatgagcacgatgtggtgattgccatttctcaaagtggagaaacggcggatacgctggcggcagtggaactggcaaaaagtcggggtgcatttatatatggtatctgtaatgcgattggttcctccatcccccgcgctacgcatacggggtcgtacatccacgtcggaccggaaatcggagtggcatcgaccaaagcatttaccggacaggtgactgtgctgaccatgctggcattgactctcgcccgggagaaaggtacgatagacgagacacaatacctgaacattgtacgggaattgaatagcattcccggcaaaatgaaggaagtattgaaactgaatgataagctggcggaactgtcgaaaactttcacctatgcgcataactttatttacctcggacgcggatatagttatccggttgctttggaaggtgcattgaaattgaaagaaatatcgtatattcacgccgaaggttatccggctgccgaaatgaagcacggaccgatagccctgattgatgccgaaatgccggtagtagtcattgctacccaaaacgggttgtatgagaaagtacttagcaatattcaggaaatcaaggcacgaaaaggaaaggtgattgcatttgtaaccaagggcgatacggtgatcagtaaaatagccgattgcagtatcgaacttccggaaacaatcgagtgccttgatccgttaattactacggtacctctccagttgcttgcttatcatattgcggtatgtaaggggatggatgtagaccaacctagaaatttggctaagtcggtaacagtcgagtagtttaaaatgtaaatagtcaaatagtaagagatagattaatggaacaattgaaacatgaatgtggcgttgccatgatacgcctgctccaacccctggagtattacgagaaaaagtacggaacatggatgtacggtctcaacaagctctatctgttgatggagaaacagcataaccgggggcaggaaggggcaggactggcatgcgtgaagctggaagcaaatccgggtgaggaatatatgtttcgcgaacgcgcgttaggttccggtgccatcaccgaaatcttcgaagctgtacagagtaacttcaaggacctcactcccgaacagttgcatgatgcggcatttgccaaacgtactttgccctttgcgggtgaagtatatatggggcatctgcgttattctactaccggaaaatccggaatctcgtacgtacatccgtttttaagaagaaacaactggcgtgctaaaaatctggctctctgcggaaacttcaatatgacgaatgtagatgaaatctttgcccgcatcaccgctatcggtcagcatccacgtaagtatgccgatacctatatcatgttggaacaggtggggcatcgtcttgaccgtgaagtggaacgcctcttcaaccttgctgaagccgaaggactgacagggatgggagtcacccattatatagaagaacatatcgaactggccaacgtattgcgtacttccagccgtgagtgggatgggggatatgtgatctgcggtctcaccggaagcggcgaatcttttgctatccgtgatccgtggggtattcgtcccgctttctggtatcaggatgatgaaatagccgtactggcttctgagcgtccggtgattcagactgctttgaatgttcccgtagaaaaaatcaaggaactgcaacccgggcaggcattgctgatcagcaaagaaggcagactgcggacttcacaaatcaacaggcctcgcgagcggcacgcctgctcgttcgaacgtatttacttctcccgtggcagcgatgtagatatctataaagaacggaaactcttgggagaaaaactggttccgaatattctgaaagccattaataacgacttggaccatactgtattttcctttatcccgaatacggccgaagttgccttctacggaatgttgcaagggctggatgactatctgaatgaagagaaagtacggcagattgcggcattggggcatcatcccaatatggaagagctggaggtcattctttcccgccgtatccgcagtgaaaaagttgccatcaaagatattaagctccgtacattcattgccgagggaaacagtcggaatgacttggctgcccacgtatatgacatcacgtacggaagtctggtttccggtgtcgacaatctcgtgattatcgacgatagcattgtgcgtggtactaccttgaagcaaagtatcatcggcattctcgaccgtcttggtccgaagaagatcgtgattgtatcttcttctccacaagttcgttatccggactattacggcatcgatatggcgaagatgagtgaatttatcgctttcaaagctgccatcgagcttctgaaagagcgggatatgaaggatgtgattgctgccgcctaccggaaatcgaaagatcaggtaggattgccgaaagaacaaatggtgaattacgtgaaggatatctatgcgccgttcaccgatgaagaaatatctgccaagatggtagaactcctgacaccgaagggaacgaaagcgaaagtggaaatcgtctaccaaccgttggaaggactccatgaagcctgtccgaaccatcaaggagactggtacttcagtggaaactatcccacaccgggtggtgtgaaaatggtgaatcaggcatttatcaactacattgagcagatgtatcaattctaacaaccatacaacgattcaaaaataagaatgagaaatgtgacattaatccttgacgacgggagccggttttccggtaagtcgtttggctacgagaagccggtggcgggcgaagtagttttcaacaccgccatgaccggatatccggagagccttactgacccttcctacgccggacagttgatgactcttacctatcctttggtgggtaattacggagttcctccttttaccatcgaacccaacggactcgccactttcatggaaagtgaaaagattcatgccgaagcgatcatcgtaagtgactactcttctgagtacagccactggaacgcagtggaaagccttggcgactggctgaaacgtgagaaagtaccgggcatcacaggcatcgatacgcgcgaactgaccaaaatacttcgtgaacacggagtcatgatgggacgtatcgtcttcaacgatgaaattgtcggggaaattgacaatggacaattgccaatggacaattacgctgccgttaattacgtagaccgtgtttcctgcaaagaaataatctcctatcttcccgatggaacatcccgttcttttccattaaccatgcccgtcgcgcagcttaattgtcaattgtcaactgtcaattgtcaattaaagaaggttgttttggtggattgcggtgtaaagaccaatattatccgttgcttgttgaggcgtggtgtagaagtgatccgtgtaccttgggattatgattttaacggactcgaatttgacgggctgtttatctccaacggcccgggtgacccggatacctgcgacgcagctgtgcagaatatccgcaaggcaatggcgaacgagaaacttcccatctttggaatttgcatgggcaaccagttgctctcgaaagccggaggggcaaagatttacaaacttaaatatggacaccgtagccacaaccagccggtacgcatggtgggtacggaacgttgttttattacttcgcagaatcatggttatgcggtagacaataatacgctgggggcagattgggaaccgctgttcatcaatatgaatgatggttctaacgaaggaatcaaacacaagaaaaatccttggttctctgcacagttccatcccgaagctgcaagtggtcctacggatacggaattcctgttcgatgaatttgtaaacctgcttaaataaccgactatcatgaaagaaaatataaagaaagtattgctgctgggttccggtgccttgaaaatcggtgaagccggtgagtttgactattccggttcgcaggcactcaaagccttgaaagaagaagggattgaaaccattcttatcaatccgaatattgctaccgtacagacatccgaaggagtggcagatcaaatttacttccttccggtcactccgtattttgtagagaaagtaatccagaaagaaaagccggaaggtattatgctggcattcggcggacagaccgcgctgaattgtggagttgctttatataaagaaggaatccttgaaaagtataatgtaaaagtactcggtactcccgtacaagccattatggatacggaagaccgtgaactctttgtacagaaactgaacgaaatcaatgtcaagaccattaaaagtgaagctgtagaaaatgcggaagatgcccgtcgtgcagcgaaggaattgggatatccggtcattgtccgtgcggcttatgcgctgggtggcttgggctccggtttctgtgacaatgaagagcaactggatgtactggtagaaaaagccttttctttttctccgcaagtgttggtggaaaaatcgcttcgggggtggaaagaagtcgaatacgaagtcgtccgcgaccgcttcgacaactgtattacagtttgtaatatggagaactttgacccactggggattcataccggtgagtctatcgttattgctccgtctcaaacactgaccaacagtgaatatcataaacttcgtgaactggctatccgtattatccgccacatcggtattgtcggcgaatgtaatgtacagtatgctttcgaccccgaatcggaagattatcgcgtcatcgaagtaaatgcccgtctttcccgttcctcggccctggcctctaaggcaaccggatatccgttggcattcgtggctgccaaactgggactcggctacggactcttcgacttgaagaactcggtgacaaagactacttctgctttcttcgaaccggctttggactatgtggtatgtaagattccacgttgggacttgggaaaattccatggtgtagacaaggaactgggttcttccatgaagtcggtaggtgaagtgatggcaatcggacgtacttttgaagaagctattcagaagggcctccgtatgatcggacagggaatgcacggattcgtggaaaacaaagaactagtaatccctgatattgacaaagcactccgcgaaccgaccgataaacgtatttttgtgatctcaaaagccttccgtgcaggatacaccatcgatcaggtgcatgaactgacgaagattgacaaatggttccttcagaagttgatgaatataatgaagacttcggaagaaatgcacgaatggggaaataatcataaacagattgccgatctgcctgtggaactgcttcgcaaggctaaagttcagggcttttccgatttccagattgcccgtgctatcggttatgaaggtgatatggaaaatggaagcctgtatgtccgcaagtatcgtaaggctgccggtatccttccggtggtaaaacagatcgatacactggctgccgaatatccggcgcagaccaattatctgtatctgacctatagcggagtggcaaacgatgtacattatctgggtgaccataaatccattgtcgtattgggttccggtgcctaccgtatcggttcttctgtagagtttgactggtgcggtgtgcaggctctgaataccattcgcaaggaaggttggcgcagtgttatgatcaactataatccggaaacggtatctacagactatgacatgtgcgaccgtctctactttgatgaactgacattcgaacgggtaatggatattcttgagctggaaaatccgcatggtgtcatcgtatctaccggtggtcagattccgaataatcttgctttgcgtctggatgcccagaacattcacatactgggaacaagtgctcagagcatcgacaatgctgaagaccgtgaaaagttctcagcgatgctcgaccgtattggcgtggatcaaccacgctggcgtgagttgacatcgctggaggatatcaatgagtttgtcgatgaagttggtttcccggttcttgttcgtccgtcttatgtgctttcgggtgctgcgatgaatgtctgctccaatcaggaagagcttgaacgcttcctgaaactggctgccaatgtatcaaagaagcatccggtggtagtaagccagtttatcgaacatgcgaaggaggtagaaatggatgctgtggcgcagaatggcgaaatcatagcctatgcaatcagcgaacatattgagtttgccggtgtacactccggtgatgccactattcagtttccgcctcagaagttgtatgtggaaactgtccgtcgcatcaaacgcatcagccgtgagattgccaaggcattgaatatttccggtccgttcaacatccaatacctggcaaaagataatgatattaaggtaatcgaatgtaatctgcgtgccagccgttctttcccgtttgtcagcaaagtgctgaagataaacttcattgagctggcaaccaaagtgatgctgggtcttcctgtggagaaaccggaaaagaatctctttgaactggactatgtgggaattaaggcttcgcagttctctttcaaccgtttgcagaaagctgaccctgtattgggagtggatatggcttctacaggtgaggtcggctgtatcggaagtgacacttcctgtgccgtactgaaagccatgctgtctgtcggctaccgtattcctaaaaagaacatcctgctttctacgggtacaatgaagcagaaggctgatatgatggatgcagcacgtatgttggtaaacaagggatacaaactctttgcaaccggcggtactcataaaacctttgctgagaacggcattgaaagtacgcttgtctactggccgagtgaagaaggacatccgcaggcattggaaatgcttcataataaggaaattgacatggtagtcaatatcccgaagaacctgactgccggagaactggacaatggatataaaatccgtcgcgcggctatcgacctgaacgtgccgttgataacgaacgcccgtctggcaagtgcatttatcaatgctttctgtacgatgaccgttgatgatattgccatcaagagctgggaagagtataagtaagaaataataaattgttgtataataagttggaaaagtcgttcccgtgcattcgggggcggcttttttttatgaatttctgtttttgggatggtgtcactataagcatgggatagtgtcactatcctgtcagtatgcttacactatccttcctgtatagtgtcactatctttttttaatgtctataagttgcatgattggacaaattggtgtaaattgcgcaattatttcacaaatattctaaaacaggggagtaatatgagcatggataatcatatcgtaattatggctggtggcattggtagtcgtttttggccgatgagtacaccggaatgtcccaagcaatttattgatgtaatgggatgcgggcgtacgttgattcaactgactgctgatcgttttgatggcgtctgtccacgggaaaatgtgtgggtagtgacgtccgagaaatatattgatatcgtccgggagcaattgccggagattcctgaaagcaatatccttgcagagccttgtgcacgaaacactgctccctgcatcgcctatgcttgctggaaaatcaagaaaaaacatccgaacgccaatgtggtggtgactccgtcggatgcattggttatcaatacaggtgaattccgccgggtagtagagaaagcacttcgttttactgacaacagcagtgctatcgtaacgctgggtatcaaaccgactcgcccggaaaccggatatggatatattgctgccggagatcagatcatgactgataaagagatttttacggtagatgcattcaaggaaaaaccggacagggagactgccgacagatatctggccgagggtaactacttctggaatgcaggaatttttgtttggaatgtgcgtactatcacttccgtgatgcgtgtatatgctccgggcatagcgcaaatcttcgatcgtattttccccgatttctatacggagaaggaaaatgaaacgattaaaaagctgttccctacctgcgaagctatttccatagactatgccgtaatggaaaaagcacaggaaatctatgtacttccggcttctttcggttggtcggacttggggacctggggagcgctccgcggactgttgccacaagataaatccggaaatgctacggtaggggccgatgtccgtttgtacgaaagcaagaactgcatcgtacataccagtgaagagaaacgggtcgttattcagggtctggatggatatatcattgctgagaaagataatacactgttgatttgtaaactggatgaagaacagcggataaaggagttttcaaagtaatccttaattcttttgatattcctgaggcgtcattccggtcattcgtttgaaaaacttgctgaagaaagacggattgggaaagtttaattcatctgatatctgataaacaaggcggttgctatgttttagcaatactttagcctctagtataatggactggtttatccagtccattactgtttgctggctggtttgccggattacagtgttcagataacggggagtgagacaaagtttattcgcatagaaactgacattccgctctgtcttgctataggtgttgaccaaagaaatgaggcgctgaaaaatgtcgttttgatgggttaatggactgagttcggcctgccctttgcttttggctatatactctatattatatagtaatcctaccagtaaatgctgaatgacctcttttctgaatacaggttcttgcaatacactccacatgaccgtcacaaaattctctatctgtatttgttcttcggtagacagtggaaacaggagatttttcttttgttggaggaaatgggtgaagaattcttcctttccggatatcggcagaaagttcaggtctactgccatcatgtgagcatcaaaatcgtgagatacttctatgatttgtatgatagagttgggagctatcagggatatatggtcgggcaggaaaatatattcgatcagattgattaaaacacgtgccgagccattagtgacaatagcaatacggccttcctgtagccggtacggttgtccgacactgaagatagtcgtttccattttagagaaacttgtcacaaatccgaattcggcattgatgaagcgaaattcgttgtgacgtactatatttatatccttcaacagttggaggcctaattccatcggtttcttctgttccattttctcagttcttttccggcaaagataagaaatagcccttgaatcttctctttttttaggatgaatcgaactattgggacatattttccaactatcagaatgtgaaactattacttaaaggtctatctttgtcttttgaagaattcatagaaaaaatgcgtatgaaaagaattatttttagtctttcgcttttactgttcatgcccggaatgtatgggcagaccgggcatataacattagaagaatgtcagcaaaaaacgcaggataactatccgttggtgcgtcaatatgatttagtggagaagacgaaagaatataatctggaaaatgcggcgaggggatacttgcctcagtttgctctttcggcaaaggcgtcttatcaaagtgatgtgacggagttacccattgccattcccggtgtggatatcaaagggatggccaaagaccagtatcaggtgatgctggagttacagcaacagatatgggatggcggaggaatccggatgcagaagaaaaaggctacggcggaagcggagattgacagggaaaagttgaacgtcgatatgtatgcgttgaatggccgtgtgaatgatctgtattttggaatcctgatgttggatgagcagttggctcagaatgccttgctgcaagatgaactgggacggaacttccgtcagattacagcttatgtggaaaatggaatagccaatcaggccgatctggatgctgtgaaagtggagcagttgaatacccgtcagaaaagggtggaactgacttcttcccgtatggcctatttgaagatgctttcgttattgatgggagaggtgctttcgccggagacagtattggagaagcctgttcctcaaaacgaattgtcggctgtcagtgagattcgccgaccggaactgtcgtggtttgacgcacagggagccggtttgcaggtacaagagaaagccttgaatgtgcgccatcttcctcatttcggattgtttgtgcagggagcttacggtaatccgggattaaatatgctgaagaatgaattttctccttattatattgcaggtgtccggctttcatggaatttcggaagtctgtatacgttgaagaatgaccgtcgggtgattgaaaacaaacggcagcaactggacagcaatcgggatgtgtttctttttaatacgagactggaaatgacgcagcaggatcagtctgtccgttcgttggagaagcagatgcaggatgatgatgaaattatccggttgcgtacgaatattcgtcgggctgcggaagccaaagttgcgaatggtacgttgacagtaacagaaatgctcagagaactcacgaatgagagtcttgcccgtcaggcgaaggcaatgcatgagattcaacggttgatgggtatctatcaattgaaatatactactaatcattaataaaaatctgtcagatatgaaacgaatgacaaaaataggaatatacgggatggcagtatggatgctttctgcctgtggaaacggaacgcccgattatgatgcaacaggaacctttgaagctacggaagtgatcgtttccgccgaagcagcgggaaaactgctgcaactggaagtggaagaaggaacaagattgaaagccggcgaagaagtagggctggtagatactgtccagctatatctgaaaaagttgcaactggaagcaagcatgaaatcggtggaaagccagcgtcccgatctggccaaacagatagccgctaccaaacagcaaattactacagcgcaaagggaaaagaagcgggtagagaacctgcttgctgccggagctgccaatcagaaacaactggatgactgggatgcacaggtaaccttgcttcagcggcagttgattgctcaggaatcctcattgatgaagagtacgaacagtctgacggaacaggggaattcggtcagtatacaagtggcacaggtagaagaccagttgaacaagtgccatattcagtcgcctattgaaggtacggtactggcaaaatatgcggaagggggagaactggcatccgttggcaaaccgttgtttaaagtgggtgaggtagaccggatgtatttgcgggcttatgttacttcagagcaattgtcccaagtgaaattgggggataaagtgacggtgtattccgattatggaaattcggaacagaaagcctatcccggtgtggtcacttggatttcggaccgttcggagtttacccccaaaacgattctgactaaaaatgaacgtgccaatctggtatacgcagtgaagattgccgtgaaaaatgacggttcgttgaagattggtatgtatggaggtgtggtatggaaaaaggagaacccatagtcgttgtaaaggaaatcagcaagagctacgggaaagtagaggcactgaaagaggtttcttttgcggtagagcagggagaagttttcgggctgatcggtcctgacggggcggggaagagtaccttattccgcatcctgaccactttactgttggctgataaaggtacggcaactgtcaacggactggatgtggtgacggattacaaacagattcgtacgaaagtaggatatatgcccggacggttctcgctttatcaggacctttccgtagaagagaatctggaattttttgctacggtatttcatacgttgatacaggaaaactatgatttgattaaagatatttatcagcagatcgagccttttaaaaaaagaagggcaggcgctttgtcgggaggtatgaagcagaagctggcattgagctgttccctgattcataaacctgatattttatttctggatgaaccgactacgggtgtagatcctgtgtctcggaaagaattttggcagatgctccgtaatttgagaaaacaggggattacgatcattgtttccactcctattatggatgaggctcgtcaatgcgaccggattgcttttattaatcacgggcaggtgcacggaatcgatacgcccgaacggattcttcagaagtttgcttccattctttgtccgccacccttggaacgggaggaggcgcaacagatggcagctcctgttatcgaggtggagcagctgaccaaatccttcggacattttacggcagtcgatcatatctcttttcaagtgcagcggggagaaattttcggttttcttggagccaatggagcaggtaagacgactgcgatgcgtatgctttgcggattgagccgtccgacttcgggagtaggaaaggtggcaggctatgacatctttcgggaagccgaacaagtcaaaaggcatatcggatatatgagtcagaaattctctttgtatgaggatcttaaagtctgggagaatatccgtctctttgccggaatttatgggatgaaggagatggagattgaagaaaagacagatgaattgttagaacgcctgggatttgcagacgaacgggatacgttggtgaaaaaccttcctttgggttggaaacagaaactggccttttctgtctctatcttccatgagccgaaaatagtcttccttgatgaaccgaccggaggagttgatcctgctactcgcaggcagttctgggagctgatttatcaggctgccgatcgtggaatcactgtatttgttaccacacactatatggatgaagcggaatattgcaaccggatatcgattatggtggacggccagatcaaggcactggatacgccggcccggctgaaagaacagtttggtgtggagacaatggatgatgtgtttcaacaacttgcccgccatgcggtgcgtaaagcggattgattatgaaacaatttattgctttcgtaaagaaagaattttatcatattttccgtgaccggcgtactatgctgatcctgttgggaatgccggtcgtgcagattattctgtttgggtttgctatcagtacggaagtgaagaatgtccggctggcagttcttgatccttcgaatgatgtggtaacaaggaaaattatagaccggttggatgcgagtgaatatttcacggttaccacccgttttcattctccacaggagatggaaactgccttccggaaaaataagatagatatggcaattgtatttggagagcgttttgccgacggactttatacgggggatgcccgtgtgcagctgatagtcgatgcaaccgatcccaatatgtctacctcgcagagtaattatgcagccagcattgtttcttcggcaggacaggagatgttgcctcccaatgtgttcgtttcgcgtttgactccagatgtcaaattgctgtataatccgcagatgaagagtgcctacaactttgtgcccggagtcatggggctgattttaatgctgatttgtgcgatgatgacctctatttccattgttcgtgaaaaggagacgggcacgatggaagtattgctggtatctccggtaagaccattgtttatcgtgctggccaaggcggtaccttactttgttttatcttttgtcaatctgacaaccattttgctgctttcagtctttgtactggatgtgccggtagtggggagtttgttctggttggtgatggtgtctttgctctttattttcgtgtcgctggctttgggtttgctgatttcctctgtgacaagtacacaggtggcggccatgctggcatccggaatgatattgatgatgcccaccatggttttgtccggaatgatttttccggtagaaagtatgccggtgattctccgggccatatcggatattattcccgcccgctggtatattcaggctgtgcgcaaactgatgattgaaggagtgccggttgtgctggtacttaaagagattggtattttgttgctgatggcagtagtgcttattaccatcagtatcaggaaatttaaatatcgattggaataaaggaatttattatgataaaatttctgatagaaaaagagtttaaacagttgcttcgcaattcgttcctgccgagattgattcttatctttccctgcatgatcatgttgctgatgccatgggctgtgaatctggaaataaagaatatccagctgaatattgtagacaacgatcattcggtgatttctcagcggctggtgaataagattgcggcttctacctatttccgtctgacggaagtgccggcatcttatgaggatggattacggaatattgaacagggaacagcggatattataatggagatccccaggcacctggagcgggactgggtgaacaaaggagaagcccatatactgattgcagccaattcggtaaatggaacgaaaggagggctaggcagttcttatctgggcactattatcaagaactatgcagccgagttacgtgcagaatatcctgatgccatatctgcgtcgggcagtgccccttccattcgtatcgatacgcagggattatttaacccgaatctgaattataaactttatatgattcctgctttgatgggaatgttgttgactttgatatgcggatttttgcctgccctgaatgtggttagtgagaaggaggtaggaacgatcgaacagattaatgtgactcccgtaccgaaatttacttttattctggctaaacttttaccttactggatcacaggctttatcgtattgactttgtgctttttgttagcctggctgctttatggaataactcctgtagggcatttcatcgtgatttattttttggcgattttgtttgtattcgttatgtccggtttcgggctcgttatatccaattattcggcaactatgcagcagtctatgtttgtaatgttcttttttatgctgattctgatgttgatgagcggattattcactccggtgagcagtatgcctgaatgggcacaggtgattacttatttcaatcctttgaagtactttatggaaggaatgcgtatggtatacctcaaaggaagcagcttgttggaactgctgcctgaaataggagtcctgcttctttttgcactgggtttcaatacctgggcggtgatcagttatcggaaaaatcaataattgagaatttgattatataaaaaacagctcttatccttattggttggaaaagagctgtttttattattgttttcaccccttgggatgaatcgtggttactgtattattttacttcgatttgcttttcggccttcttcacttcttcttcagaaatcttaggaagttggacgctcaaaactccgttttctactgcggcagaaattttttctttatctacattatccggcagaatcatcgtctgctgaaacttagaataagagaattcgcgacgtagatagcgaccttctttcttctcttctttgttttcagtcttcttctccatagagataacgaggttgttgtcttcatcaatgcgaacattgaagtcctcttttgtcattcccggagcagccagttcaactttgtattctttttctgtttcaaaaacattgattgcaggtgcagttgcatttgcttttaccatccaatcgttatcaaagaaatcgttaaaaatacttggtaaccaactttgagttcttctaacaggcatcataatcttagtctcctatcttttagttaaacattcggtttattcactcttgaatttcggttcgctgctttccgcagaggggggtatcccgactcttgccgtctgcttttgaaccgtcgttcactgctattagtgcaaaccttatgccaaaggaaaactgagattgaaaatgtctatttgtcattttaataatgccaattttgcctgttttgtgacaaaatgtaaccgcagtatatttattttatataatatagatattaatttgataatctattttttttcaatgagtttgaatcttaaccttaaagtttgcctttcttcattataatcatgactgatgattttgaaagttcctacctctgaggtattggatacatgtaaccctatacaggcacaggcgtcataatctcctatgcgtataatgcgaagagtctcactggcgtcagcaggaagtttgctcagatctacgatgcctttagcttgctcatgagtcataaattcaacagttacgggcagattttgactgataacttcgtttaccttatcttctatcgcttgtatctccgcatctgtaggacaagtaggaagaatatagtcgcacttactctttttcctttctatatgggcatttcttgagcgagggcaaccgaaagtttttaccatagtggcatttagtaaatgctctgctgtatgcataggaggatactcctgtttgttgtgatcattgagttgaggttgttgttccataaatttttcaataactttttgtttttgatattttcttatttgccggatggcagtttgtacttttctcccaggaaatgcggttgcttatctatcgctaaatcgataaacatcttgacccttgcaaataattctctgatattggttctcaatcctgcatagacgtctacatccctggcattaaaaccgatggcggtaatcccattcttttcggcaagataaatagcccgctcattgtgaaatcgttgagaaatgatggtcagacgggtctgaccgaatacttctttagcacgcacaacagagtcaagggtacgaaaaccggcataatctaaatagatagacttttcaggaacacctttttgcataagcgctttcttcatttcttccggttcgttgtaatcttctttgcgattatctccactgataagaatataattaattttgcctgccttgtacagttcaaccgccgcatcaatgcgatagtcaaaatataaattgttatttccgcttttcagcttaggagaggtgccgagaagcagacctacattgtttgcaggaatatcactgatttcagtatagatgcaggaggctgcattcttcttgatggtccagtcgcagataaagatactgataacacaaagtatggcaattatcagtgtgatatagaatagtttttttttcattttccgaataattcactcatataatcaagggaacggctaatgtcgaaatacatttgatttccttcatagtactggcatttatcaaactctatcagatcacatttattgactagcgattgacctttcatgttttccattttgaataacatgttcagcagttggtattcgtcatttacgcagataaccttaaatgcggtttcttcgcttgtaccgtcacctgtaagcgcaatcatagtaagcaaggctgcgtatctttttgaatagtgttttatttcccggatatctttctggagcaaaccggctattccgtacatattatatagtaattggagagataccggattcttttttagtagttctttgccgatattataagcatcttcatacttttcttctttaatcaactttcggaaatcctgaaaatcatccatacttcctttgtaagctggtgtgaatgaatacccgtaatatagcatggcatgatcttgccgggtgagtaaagtatcattttcttcaaaacgttgcatgagcttttgaaattccgtattgtgattagtcacgtactctttgatggccggataatccacttttaatatttcttgtgcggaacaataaacctgaaggctaagtatgcttataaagaaaagggtaatgagctttttcatgacagtgtttttttagggtattatgattcacaaaaataccattcttttttaggaaaccaagcgtataggcataaaaaaaggagcaacgccttgctccaacctttgttaaccttaaatctaatactatgaaaaacacattgcaaagatacggacttctgtgaactttgcaaattaaccaagaaaaatcttatgttatataacatagattaagaattttccctttccgcttaacggatattcggtatttgatcgttcatataaagagtttttttatctttgcaaccaatttgaattactaatctttatatatgtatatgaaaaagaaaagactgggtcaatggatgttgttggccatcgtttgtttgagtttctcagtaggagagacctatgcacagaaacatgagttcgctaattacaagcgttatgcgacagagaatgcagcacttgcacaacctgtaaagaaggaaaaaagagtggtctttatgggcaattccattacggaaggatgggtgaggacacatcctgatttcttcaaaacaaatggatatatcggtcgtggtatcagtggccagacgtcctatcagtttttacttcgttttagggaagatgtgatcaatctttctccggcattggttgtcattaatgcaggaacaaatgatgtagccgaaaatacaggtgcttataatgaagattatacattcggaaatattgcatctatggcagaactggcgaaggcaaataaaatcaaagtgattctgacttcagtattgccggctgctgaatttccgtggagacgggagattaaagatgctcctcaaaagattcagtcattgaatgcccgcatagaagcttacgccaaagctaataaaattccgtttgtgaattattatcagccaatggtggtgggcgagaataaggccttgaatcctcaatatacgaaagatggggtacatcctacaggagaaggatatgatatcatggaagcactcattaaacaggctattgaaaaagcgctttaattatagatagagtgtagataaaaaatgccctttgataagatttcaaggggtatttttgtaggattggaagatgctaagatggggtatgggcataaaaaaaggagcaacgccttgctccaacctttgttaaccttaaatctaatactatgaaaaacacagtgcaaagatacgggcttttgcgaaatctgcaaattatttctcttaaataggtgtttttataacactaattagcaaaagctcgggtttcttatagatttattgatatttataagccgtttatccccacttttctttcatcaaatcttccagtttcagcagctcattccgatattgggcagcttcgataaattccagttttttggcggcctcctgcattaatttgcgggtacgctctatgctcttttccatttgagctttgctcatatattgtacgattgggtcggctgcgatattaggtgaagaaggttccacataagcgtgtttttctttcagcaactcatcggcttcggaacctggactgccaaatacagacaagtttctcgccttcttgatttgttgtggggtgatgccgttcgcttcattataagcgagctgtttctcgcgtcgacggtttgtttcatcgatcgtaagccgcatactgtctgttattttatctgcatacatgattacttttccgtttacattacgggcagcacgtcctgcagtctgggtcaatgagcgatgcgaacggaggaagccttccttatcggcatcgagaatagcgacaagggatacttccggaaggtcaagaccttcacgaagcagattgacaccgataagtacgtcataaacgccttgtctcaagtcatccatgatcttcacacgctctaatgtatccacatcgctatggatatagttacatctcacattattgttgagaaggtattctgtcagctcttccgccatacgtttcgtaagtgtcgttacaagtacccgttcttctttttcgatacgcagctgaatttcttccatcaggtcgtcaatttgattgagactcgggcgtacttcaataacaggatcaagcagaccggtagggcggatcacttgttctacaacgatcccttccgattgtatcagctcatattctgccggggtagcactgacataaatcacttgttttgtcatctcctcaaattcttcaaatttcagagggcggttgtccattgcggcaggcagtcggaacccatattctaccagattgattttacgggcacggtcgcctccatacatggcgcgaacctgcggcacgcttacatgactttcgtcaataaccagcaaaaagtcatccgggaagaaatcgagaaggcaataaggacgggtgccggcagcgcgaccgtcgaaataacgggaataattctcaatgccggaacagtgccctaattcccggatcatttccatgtcatacgtaactcgctcgtacaatcgtttcgcttcatattctttgccgatagattcgaagaacgctacttgtttggttaagtcatcctctatttcgtggatggcacgaagagtagcttccttggtggtcataaataaattggcgggatagatcttataggcttcgaaaggagcggtagtcacaccggtaatcgggtccacttcttctatcccatcaatctcgtctccccagaaagtgacacgaagcagagtgtccgagtacgcaaggaaaatgtcgaccgtgtctcctttaacgcggaagttgccacgattcaaatcgatatcattacggacatacaggctgtccacaagacgacgcagaaaaacattacggtcaagcatccgcccccgttcaatttcgattacatttttatagaaatccgacgggtttcccataccgtaaatacaggagactgaggaaacgactaccacatctttccggcctgaaagcagggaggaggtagcggcgagacgtaacttgtcaatctcgtcattgatggcgagatccttttctatataggtatctgaatttggcagataggcttccggctgatagtagtcgtaatatgaaacgtaatattctacggcgttattggggaaaaatcccttgaactcgctgtatagctgcgcagccaatgtcttgttgtggctcaagatcaacgtaggcttgttgatgttggcgatcacattggcgatggtgaacgtttttcccgatccggtaacccccaataaagtctgtgcgggaactccttgaagtaccccctcagtaagctgggcgatcgcttctggttgatccccggtaggtttgtaagctgatgttagttcaaaattcatagttaaatcctaaaaagtggagcaatattcggcaaaataattgagataacaaatcatttttccaaataaatcctttactttgcaacatattaatatcatgaaacagattcatacaactaataataccaagagaacatgatttggaatgagaccattgagtgtatggaccgcgaaagtcttcgcaagattcaaagcatacgactcaagaaaattgtggattacgtttatcacaacacgcctttttaccggaagaaaatgcaggaaatgggtatcacccccgatgatatcaatacgattgatgatatcgtgaaactgccgtttaccacgaaacatgatttaagagataattatcctttcggactttgtgccgtgccgatgagccagatcgtgcgtattcatgcctcttccggaacgaccggaaagccgacggtagtgggatatacccgcaaagacctttcttcgtgggcagaatgtatatcgcgtgcttttactgcttatggagcaggacgctcagatatatttcaggtttcctatggttacggactttttacgggtggcctgggagcacacgccggagctgagaatattggtgcttctgtgattccgatgtccagtggtaatacagaaaagcagattacattgatgcatgattttggatcaacggttctttgctgtactccttcgtatgcactttatctggcggatgccattaaagattccggctatccgcgggaggaattccaactgaaagtgggagccttgggtgcggagccctggacggagaatatgcgtcatgaaatcgaagaaaaactcggtattaaagcatatgatatctacggactgagtgaaattgccggaccgggtgtaggttacgaatgtgaatgtcagcatggtacgcacttgaatgaggatcattatttcccggaaattattgatccgaatacattgcagccggtagaacccggacagacgggcgagctggtatttacgcacctgacgaaggaaggaatgccattgcttcgttatcgtacgcgtgacttgacggccttgcattatgataaatgctcctgcgggcgtacattggttcgtatggaccgtatcctgggacgtagtgacgatatgctgattatccgtggtgtcaatgtattcccgactcagatcgagtccgtcattcttgagatggaagaattcgaaccacattatttgttgatagtggggcgtgaaaacaataccgatacgatggaacttcaggtagaagtgcgcccggatttctattcggatgagattaaccgtatgctagcgttgaagaagaaactggcaagccgtctccaaagcgtacttggactgggagtcaatgtgaaactggtagaaccgcgtagcattgaacgcagcgtgggcaaagctaaacgagtgattgataacagaaaaatttaaaataggtaataggtaataagtattaggtattatcgtagctgcaacatggaatccgtgtggctattacctattacctaatatttaatacttattacttaatacctaatacttaaaactttacgataatggtagcaaaacaactttctatctttttggaaaacaagtccggccgtttgacggaagtgactgaagtgctggcaaaagagaacatcaatctttctgccttgtgcatcgctgaaaatgctgattttggcattttgcgtggaattgtatccgatccggataaagcatataaagcattgaaagataatcattttgccgtgaatataacagatgtggtcggcattagctgtccgaatgtgccgggagctctggcaaaagtgctgggattcttgtcggcagaaggggtctttattgagtatatgtattcgtttgccaataataacgtggcaaacgttgtgattcgtcctagtaatatggataaatgtattgaagtactgaaagaaaagaaagtcgacctgttggcggcaagtgatttgtacaagctgtaaccggacggcggaccataagcgaacggtgaacgaagaacgatagcgctggtataccaatgacatatagcgcgcttgttgatcgttcaccgtttattattgactgtttatagcttcctgttcgacgtcgttttttctcttttcgtcgatgtttaacgccttttatgtattaaaaaacatagattaattggttaattccccgcgaataagtaactttgcgcaatattttttaaaaggatgaagaaaaatatcattataactttgctcgcagcagcctctctgacatcgtgtggagagtacaataagttgctgaaaagtaccgattacgaatacaagtacgaggccgccaaaaactattttgctaaagggcagtataaccgctcagctaccttgctgaacgaattgattacaatccttaagggaaccgataaagcggaggagtctctgtatatgttgggtatgagttactataatcagaaagattatcagacagctgcccagacgtttatcacctatttcaacacttatccccgtggtactttcactgaactggcacgtttccatgcaggtaaatccctgttcctggatactccggaaccacgtttggatcaatcaagcacttatcaggctatccagcaactgcagatgtttatggaatatttcccgaacagtaccaagaagcaggaagcacaagatatgatttttgctttgcaggataaactggtgttgaaagaactctattctgcaaagttgtattataatctgggtaactatctgggtaataactatgaatcctgtgtaattacagctcagaatgctctgaaagattatccttatacagattatcgcgaagaactttccatattgattctgcgtgccagacatgaaatggctatttatagtgtagaagacaagaagatggatcgttaccgtgaaacgatagatgaatattatgctttcaagaacgagtttccggaaagtaaatacctgaaagaggctgaaaaaatattcaatgaatcacagaaagtaattaaagactaaatttaaatagatttatggactacaaaaaaacgaacgctcccgctacgacggtaacccgtgacatgatggaactctgtgctgacacagggaatgtttatgaaactgttgccattattggtaagcgtgctaaccagattagtgtggaaattaaaaacgatctttctaagaaattagcagagtttgcttcttacaacgataatttggaagaagtattcgagaatagagagcagatcgaaatttctcgttattatgagaaattgccgaaacctgacttgattgctacacaggaatacatcgaagggaaaatttattatagaaatccggctaaggagaaagaaaaacttcagtaatttattttctaacgaaagaattgatagtcaagtagtaagcgggaagcattttcctattccttattgcttggctattattgtttaacttaactactatagaatacttatgattcaacgaattcaaagtttttacttattgattgtaacagggttgctgattacagcaatgtgtttaccgatgggatattttattgacactacaggagaacatccttttaaagcactggggatagacgtgaatggaattttccagtctacttgggggatatttggtattctgatgctgagcgctctggtagcttttgcgactatttttctgtataagaaccgaatgttgcagattcgtatgtcaatcttcaatagcttgttgctggtgggctattatattgccttcattgctttttattttgcattgaagagcgatgccaatctgttccgtattggttgggcgctttgcttaccattggtgtctatcgttctgaatgtgctggctattcgtgctatcggacgtgacgaggtgatggtaaaggctgcagacagacttcgataagaatgcgggaagctctcgcattgggagttcctgatagaataaaacaggcgcgaatttcgcagactcacggaaatataaaccgtaggttcgagcgagattcgcgcctgatctttttgggtactgcttcttatttctttaaatcgaatagataagtaagcttcactgtaattgtgccatgagccgcacgggagaaatagtctttcttcgttgtgctgtaaaagtctgacagagcaaaataatagcgtccttcgagcagaaaactaccggctttctttgttctgaattctattccgccgcctccggctataccataatcgaatttgttttggattttatccccgtaaacagctttttgagtgtctgtcagggcattcatgtctatattctccatgctttcagattcaccgatcagaaggccgatctgaggacctgcattgataaagaactgtagtcctttttcattgccgaaagccaagtgggcgaggaagggaatatcgagataggtcatctttcgggtgtatttgcgggtaggatcttctacgggttctccattctcccccggtacttcaaataattcatcccagccacgttgggagatatttaactctacttgcgcaccacagatcatggcaaaatacttttcggaaatgtagcgtgccgtcaaacctccggtaatacccatcaatgagttctgtttgattttaggagtgaatgaagcgctgtttaagttgactcctccattaaatccgacagaaaagttctggcgtggttcgccgatctgtgcggtggcaggaagtgcaagtcccatcatcagggaagcggcaatcagaagtgattttatctttgtcattttcgtcttattcgaagtcaagttttactaattcaaaattcttcgtgaaatggataaagaatactttcttattaatgaatcctccccagttgttgacacgttcgaatttgaagcctgtctgtatcggagtcaggttcattttcggtaaattgttttccagttccgagccatagcgtgacaagcctttcaggaagaagaagcctgtgtcgaaaccaagcattccgtagcttgggaatttactcaccaagtccttgctataccatttgtgataattgttggtgaactgtatggcagccggaaacaatgtatttgtgtagaacgatgaatagaaataggtatccagttcaaagaaactttccaggtgatcccgggtatatgtctgccattcgggataaccgaacagatgaatattctgctccggagtatctctgaccagtagaatcagttgaggaagaatcttgattaacatgacatttttgccggaagtcggaatgaaaatattgtctttgtcaaagcggagagcttccttcagcatatccttggttgcgttttcattgacggttttcattgacattcccttgctcttcagctcttgtttcatgccgctgataaactcggctttttctttatcttcgctggttggttcaataaagatgacatgggcattggggaattgacgggtaaagtgttcgtatacttccgaatataaataggattgcggggtattaatctggtagatggcaggattattaaatacttcttcccctttcgaagagaaaggaatcaccagtcgtatatcattcttttctgcaaaagtagataaaggtttgatctgttgctggtgcatcggaccgaaaatgacattcatgttcttcatctcatttttcgccagaatagtatttaatgtagaaacatcttttccacagtcatatacatatagatcaatagaagtacccgtacgtttcaggctgtctaccgccatcaggaaaccttcgtagtattccaccatacgtttgtcttcctggaaaggcaatagcagggccgctttgatagtagagattgcttgaggggcttctttactcttgcggaaaagctcattgttactgggtgggatagcgtacggatcctctttgggagccgtcggttgcatggtggttgcactgggataggggatacagaggtattgtccctttttcattccctttttcagttcgggattggctgcaatcaattcctgttcgctgattccatattcgcggcttacactgaatacggtttctttgcgttttaccttatgcatatctttgcatctggattgtacaggcccctgtatagcgggtttttcagccggtgcttgtgcagtttccgtttcctgctcttgttccaacggaatgagaataacctgaccgatacggaagttttcggcgcttaatcccggattggcttcacaaatggcttttgcagatatattataaatggtagtcagtttgtataaagtttctccggcttgaattgtatggaatgtttcccctttttggctttcttttcctttagggatttttatagcttgtccggcataaattttttcatcacatccgggattcagacgtatgatgtcgtttgttgtgacattatacatcttggcaatggagtataaactctgtcctttttcgatggtatgcaagaaataagattggttctcttgtgcataactaatagcgtatgaggcgcttataaaaagcaaaaataagaatattcggcttatcggtttcatcaatttataactattggttcttgaaatcaaggaacaaaggtacgaataatgccctatatcttcataagatttgagttaagaaaataatattgtgcttttttaggagcatatttcagtcggaaacattaattttgtaccgtttatgaaggatatgaatatgcaagaaacagaatatattaatgtgtatggtgcccgtgtgcacaatttgaaagatattgatgctgaaattccccgtaacagtttgacagtgattaccggattgagtggtagtggtaaatcttccttggctttcgatacgatatttgccgagggacagcgccgctatatcgagactttttcggcctatgcccgcaactttttggggaatctggaacgtccggatgtcgataaaataacagggctgagtccggttatctctatcgaacagaaaactacgaataaaaatccccgttctaccgtgggaacaacaacggaaatatacgattatcttcgtctgctctatgcccgtgcaggtattgcttattcgtacctgtcaggagaggagatggtgaaatatacggaagaacagattctggatttaatcctgaaagattataaaggaaagaaaatatacttgctcgcacccttggttcgttcgcgtaagggacattacaaagaactcttcgaacaggtgcgaaagaaaggatatctctatgtacggatagacggcgaactgcgtgaagtgacgcacggcatgaaactcgaccgttacaagaatcatgatattgaggtagtcattgataaactgatagtagccgagaaagatgataaacgcctgaaacagagcgtggcaactgctatgcgccaaggtgatggtttattgatgattcttgatgcgcagacagaaagtgtccgtcattacagtaaacgcctgatgtgtccggttaccggactgtcttatcgggaaccggctcctcataacttctcgttcaactctccgcagggagcgtgcccgaaatgtaaaggattaggcgtggtcaatcagattgatgtcgataaagtgattcccgaccgtgaactttccatctatgaaggagcgatagcacctttgggaaaatacaagaatgccatgattttctggcagatcggtgctttgctggagaagtatgaagctactttaaaaactccggtgaaggaattgtcggatgatgcggttgaagaaatattatatggttcggatgaccggatcaagatcaagagttcgctgataggaacttcttctgattactttgtaacctatgaaggagtcgtaaaatatatccagatgcttcaggaaaaggatgcttctgctaccgcgcagaagtgggcggagcagtttgcccgtaccactgtttgtccggaatgtaaaggtgcccggttgaataaagaagcattgcacttccgtattcatgacaagaacatcaatgacttggccaatatggacatcaatgagctatatgactggttgatgaacgtagatcaatttctgtccgataaacaaaagaaaatcgcagccgagattctgaaagaaattcgtacgcgtttgaaattcttgttggatgtaggattggattatttggcattgaaccgtagctcggtcagcctgtccggtggtgaaagtcagcgtattcgtctggctacacagatcggctcgcaattggtgaatgtgctttatattctggatgaaccgagtatcgggttgcaccagcgtgacaatctgcgtttgatccgctcgttgaaagagcttcgtgatatgggaaactcggttatcgttgttgaacacgataaagatatgatgctggctgccgattatgtgattgatatggggcctaaagccggtcgtctgggtggggaggtagtcttctcgggaaccccgtcagaaatgcttcaaaccgaaacgatgacttcgcagtatctgaacggagagatgaaaatagaagtacccgccaagcgaagaaaaggaaatggaaaatctatctggctgaaaggagcgaagggaaataatctgaaaaatgtagatgttgaatttccgttagggaagttgatttgtgtgaccggagtatccggaagtggtaaatcgacgttgattaatgagactttgcagccgattctttcacagaaattctatcgctctttgcaggatcctttggaatacgattctatagagggactggaaaacatagataaggtagtggacgtagatcaatctccgattggtcgtaccccccgttccaatccggccacttatacaggtgtattttccgatatccgtaacttgttcgtaagccttccggaagctaagattcgcggttacaagcccggacgcttctcttttaatgtatcgggcggtcgttgtgaagcctgtaccggaaatggatacaagacgattgaaatgaacttcttgccggatgtgtatgtgccttgtgaggtttgccacggcaagcggtataatcgcgaaacgcttgaagtacgtttcaaaggaaagtctattgctgatgtgcttgatatgactataaaccgtgctgtcgaattctttgagaatgtgccgcagattctgaataagataaaagtcttgcaggatgtcggtttgggctatattaaattagggcagtcatctactaccctttctggtggagagagccagcgtgtgaaactagcaacagaattgtccaagcgagataccggtaaaacactttacattctcgatgaaccgactaccggacttcactttgaggatatccgtgtattgatgggggtacttaataagctggtggacaaaggtaataccgtcattgtaatcgaacataacctggacgttatcaagatggcggattatatcatagacatgggacctgaaggtggtaagggcgggggagtactccttagctacggaacaccggaagaggttgcgaagagccagaaaggttatactcctaagtttcttcgcgaggaattaggactttaatattgaagtataagtgtcggcttactaaaaagaaacaacaagatgaaaatcaataaaacgaatgcggcgcgtctgctggataaagctaaaatagcttatgaactgattccttatgaagttgacgaaaacgatctgagtgccattcatgtagctgccagcttaggcgagaatatagaacaggtatttaagacactggttcttcacggtgacaaaagcggttattttgtttgcgtcattccgggtgagcacgaagtcgatctgaagctggcagcaaaggcttccggcaataaaaagtgtgatctgataccggtgaaagaacttcttccgctgacgggatatatccggggcggctgttcgcctattggcatgaagaaacattttcctacttatattcatgaaacctgccggcaatttccgtatatttatgtaagtgccggtgtacgggggctgcagataaagcttgcgccgggtgatttaatccgcgaatcgagggcagaaatttgccgtttatttgaggaataaatccaaaaaagtatatatttgcagaatatatgtcattagaaaaattatcaatcattaattaataaatttatatctatgtttgacaaacaccctaaaggactgatagcagccgctttagccaatctaggtgaacgctttggcttctatacaatgatggcgatcctcgtgcttttcttgcaagctaagtttggaatgaatggaaaagaagcgggatttatttattcaactttctatttttccatttacattcttgctttggttggaggtattatcgccgataagacacgaaactacaaaggaactattttcacgggaattgtgctgatggcagtgggatacttgttgttggctattccatccaagactccggtagacaatcagaccttttatctggtcattacttgcgccagcttgtttgtgattgcatttggtaatggattatttaaaggaaatctgcaagctctggtagggcagatgtacgataatcctcaatatgccagcatgcgtgactccggtttctccttgttttatatgttcattaatatcggtgcaatctttgctccgtttgcagcggtaggtgtacgtaactggtggttgtctactttcggttataattacgatgctgatcttcctgcattatgtcacggtcatttggctggtactttgtcgcccgaagctactgaaacttatcatacgttggtagagaaagcttccaacgctccggtacaggattatacagcttttgcatccgattacctgaacgtctttactacaggtttccattatgcatttggagtggctatcattgctatggtcatttctttgactatctatttgctgaataagagaaacttccccgatcccagcaagaaagccgttgcgtcttcagcatcttcggctactgtagaaatgagtattcaggaagtgaaacaacgtatgtatgccctgttcgcagtgttcggagttgttatcttcttctggttctctttccatcagaatggtttgactttgacatactttgcaaaggaatacactgaccttaacttgtttggtatgcctatttccgctgagttgttccagtcgttgaatccgttctttgttgttttcctgactcctgtgattatggcaatctttgccagccagcgcagacgtggaaaagagccttctactcctaagaagattgcaattggtatgggtattgccgcattggcctttatcgtaatggctgtcggttcttattttgccaatctgcctttgcacaaggacattatcgctgtaggaacttcaccggtgaaagtgactccgttcttgttgatgctgacttatctgattttgacggtagctgaattgtatatttctccgttgggaatttcatttgtgtctaaagtagctcctccgaaataccagggtattatgcagggaggctggttaggtgcgactgcacttggcaatcagctgttggtgatcggtgctattttgtatgaatccattcctatctggatgacatggacagtatttgtggtagcttgtactatttcaatgtttaccatgatcttcatgctgaaatggctggaacgcgtagcgaaataagcccgcttggtaataaataaacgaatgccccggaacattgattgagtaacaatctgttccggggcattttgtatatggttaccttacttttcagatatccagtcccatgatataatcattcatatagtacccgttgccaatcggaaaatccccttcccgcaattttctcatacccatccgttcatagaacagtaaagccttgttgttacggttcacgttaagctccattaagcaaggttccggatgcacctccttgatatatctgacagcctctctgaataaaaaactaccgcagtgtgcgccttgaaaatgggggaggacatagattttctgcagatggaatacattctcttcctgttgctgtacggagacatagccacagggctcatctccttcatatgcgataaaataaacatgaccttcttcttccatttgtttccggatattttcgggagagtacatccagtccatcatatagtccagttgtccgggagataagatctcttggtaagtggcgggaaatacttcaccggccatttggttgatcagaccgcaatcatctatccttgcttttcgaatagtaaacatacgtattttcttttttgtggttttatgagctgcaaatatagctattatttctttttataataaggagaaaacttcttaatgatttaattattattaaattatagtactttgtaatgcaaggtactagagtaatgcatatatttgtcctgtcaaaaagaaaaataacaatgaatgtagacaatgtaaaatctcagatgagaaaaggcatgttggagtattgcatcatgcttttactgcacaaagagccggcttatgcttctgatattattcagaagttgaaagaggcacagctgattgtggtggaaggtaccttatatccattgctgacacgtttgaagaatgacgatttgttgagttatgaatgggtagaatccacgcagggacctcctcgcaagtactataagctcacagaaaaaggagaggcttttttaggcgagcttgagatatcctggaaggaactgaacgaaaccgtgaatcatattgctagtagataattcgataaagaagaaataataatgaaaaaaacattgactgtaaatttgggaggaactgtctatcatatagatgatgatgcctaccgcttgctggacgactatctggccaacctgaaacatttttttcgcaaacaggagggggcggaagagattgtgaatgatatcgagattcgtattgccgagctgtttgccgagaaagtgtccgcagggaagcaagtcattactattgccgatgtggaagaaataattgcccgggtaggcaaaccggaagattttggtgtatctgacgacgaatccgaaccgcataagaaggaacagacagcttcttccggtcagggatatacacggaccactacagcccgtcgcctgttccgtgatccggataataagttgcttgggggagtagcttccgggctggcagcttattttgactgggatatcacgttggtgcgtatcctgatgatcgtattattgtttgttccctattgcccgatgattatcctttatattataggatggattatcattcccgaagcacgtacggcagcagagaaactgagtatgcgtggcgaagcggtaaccatagaaaatataggcaaaacggtgacggacggatttgaacgggtggccgacggggtcaataactttgtgaactcggataaaccgcgtacctttctgcaaaaagtaggagatgtatttgtcacgatcgccgctatcattcttaagatattcctggtagctcttgtcatcatttgctgtccggtattgttcgtgctcgctgtggtgatagtagctcttgtgtttgcggtgattgctgcgcttgttggcggcggagctctgctttatgaaatgcttccggctattgactggacgcctatagctaccatatctcctgtgatgacattgcttggcaccatttcaggaattgcactcattgccattccattaggagcttttctgtacactataatgcgtcagttgtttcattggtcaccgatggggaccggcttgaaatggtctctgtttatcctatgggtattgggactggtcatcgtgattatcaatttgtcagctctcggatggcagctgccgttgtatggactgcattgcttttaatataagatcgctctattaaaaaagaataatatttattctttttctgagaaatgtgccccgatagtgtgtccggggtacattttttgtttgtccctctttgtaaatcgagatttttaattaagtttgtgaggacttattcaatagataaagaaaatgggtgaacatatatgtttcaggagaaacgaacgtttggctaccgtcaatccttattggagaggaaatccgatggtacgcggacgtttttttaacaggcagcaccgtttccgccccggtatgggaagtgtgttgaaatggcggttgtcccccaatcctcagcggaaagaaaagaaaacggtgaagtgggacccaaaagtctgttatcttcgttcgctggatgctgtggtgggagattctttaatatggctgggacataattccttcttccttcagttggcaggcaaaagaatcatgttcgatccggttttcggaaacatcccttttgtgaaaagacagagtgagtttcctgccaatcccgacatttttacagaaattgattacctgcttatcagccatgaccattttgatcatttggacaagcaaagtatcacccgtttgctgaataataatccgcagatgaaactgttttgcggtttgggaaccggagaactgataaagagctggtttccggaaatgagagtgatcgaggccggctggtatcagcaactggaagatgaagggctgaaaataactttcttgccggcacagcattggagcaaacgttccgtacgtgatggagggcagcgattgtggggagctttcatgctgcaggggaatggtgtttctctctattatagcggagacacagggtattctacccattttagggaaatcccggatctgttcggagctccggactatgccttgttgggtattggtgcatataaaccccgttggttcatgcgtcccaatcatatttccccttatgaatcactgactgcctccgaagagatgcatgcaggaataaccattccgatgcactacggtacatttgatttgtctgatgaacccttgcatgatccgcctaaagtatttgcggcagaagcaaagaaaagaaagattcgtgtggaaatcccttatctgggagaaatcgtaaaactgagtaaaagaaagtaattataaaataaactgagagatgaagaagttagaagtaaaagacctgaaagaaaatttctttgaggcgattggcaaagaatggatgttggttactgccggcaccaaagagaaattcaatacaatgactgccagttggggtggtattggttggctttggaataagcctgttgcttttgtttttgtccgccccgaacgatatacgtatgagttcatcgagaaaagtgattatctgacactttcttttttgggcgaagcaaataagaagattcatgcagtttgtggctcaaagtccggtcgtgatacggataaggtgaaagcaaccggattgaagccgatcttcacagaacaggggaatgtgcttttcgaacaagcccgtctaagtctggaatgcaagaagctctatacagatactattaaacccgaatgtttcttggataaagaatctttggagaaatggtatgacgatgctcatggaggttttcataaaatgtatatagtagaaatcgaaaatatttgggagggagattaattctccctttttttattttttatcggtaaagctttgataagtgatataaatattatacatttgccttaaactaaactattgtaacacaactaaaactaagcgttatgaaaacaaaaatgttctttcttgcaggtatctgtgctgcactcgcagcttgtagtagtgattcggatgatgtgtcttcttctccatccaatactccggcgatattagaggttgtttcctataagtttgtgcaggaggaaacggatgtagtagagcgggttgaatatcctgtagtagtcttgcaacataaagtaaatgataaagatgaacctcttccaatgatatatgcatgggatgtggaagaggaagagaactctttatttgtattgactgaaggttctttgcctgttaatgctgaaaatttggcggatttgaagattcctgttcctttcattgatgctggaggtaagctttttatagacggaacgggtgcgaagactccgttgatttttggagaaacattaaaagtaaagaatggatcacgttctattggaaatgtaaagtatgagatacctccctattcaacttatgagttaacaaaacaagaatgtggatatcgatgtaccttaactttttatttggtactgaaggccgtaaataaaggggaagaataccatttaaaaggcagatggactggagaacaattaagggagcaaaaaatgggattaattgatttatcagacgaaaaaggtgctgaaaaaactgttttaatggaggctccgattgagctatttgacaaggattatgaaacaggtctagattgaatcatagaccttatctaagtatatagtagcaatcgaaaatatatatcatgagtaaagtctagcggattttagatgtaatgcagaaggctctgaactcaatttgatttgagaacagagccttcattatttgtcttatatcaaagatttattttgcaggagccttcagccacttatccagccactcaaagaaagtgcgttgccacaagacgccattctgtggtttcagtacccagtggttttcatccggataaatcagcaactctgcaggtacaccacgcattacagcggcatcaaatgcagccatagcctgattagccaaaatacggaaatctttttctccatgaatacagagaatcggagtatcccatttttccacgaagaggtgaggggagttggcgaaagtacgttgtgctatcggattctgtttttcccagtacgcgccgcccatatcccagttggcaaaccatttctcttctgtttccagatactgcatttccatattgaagattccgtcatgagcgataaatgccttgaaacgtttgtcgtgatgaccggctaaccaatatacggagaatcctccgaaactagcgcccacacatcccagacgatctttatctacatacgattcttttgccatctcgtcgatagcagtgaaatagtctttcatacactggccaccataatcaccactgatctgttcgttccattccactccgaatcccggtaatccgcgacggttcggggctacaatgatatagtcgttggcagccataatctggaagttccagcgataagaccagaactggcttaccggactttgagggccaccttcacagaacagcaatgtcggatatttcttgttcggatcgaactggggaggatagatcacccatgtcaacatatccttgccatccgtcgttttcatccagcgaccttctaccttgcccatttccagctgatcataaatctccttgttctcctgtgtcagttgagtggcagaaccatccaatgctaccgcatagatctcatcacccatactcattgagtggcgtttagcaatcagtttgtcaccgaagagtgctaccccttcataatcatacatacccgaagtaatcgcctttacagaatcattcgtcaggtcaagagaataaatctgagtttctccgtgccatacacctgtaaaatagatggtcttggcatcgttgccccagacaaacgcatccacattagactcaaatgctttgctgacaaaacgcttctctccggtttccagattcatgataaacaaacggttcagatcagcttcgtatccatcgcgctccatgctttgccatgcaatgtacttgccatccggagagtattgcggattggtgtcataccccttgttttcttcggtgatattatccgttttctttgtattcagatcatacacataaatatccgaattggtagaaacagcatattccagccctgttttcttgcgacaggtataagccactttgtccgaagtcgtattccaagccagctgctcaatgccgccccaaggtttcatcggactttcgtatggttctccttccagtatatccacgatattggaaataccgttaccgtcaaagtctgccacgaaaggatgcggagcagttgtcacccattcatcccagtgcttatacatcaggtcggtgacaataatacctgtagctttcggcagatccggatatttatcggcagtgctttctttggttttcacttgcgagatgaacagcagtttcttgccgtccggtgagatagaataaccctcgatgtcaccgtcgtagttggtcagttgtttacggccgctaccgtccggattcatttcgtatagttggctgcttccgttgtcgttgctcaggaaagccagcttcgttcctccttttatccaggtcacctcattctcctgataaggagtgcgggtgatttgccggttatcgctgccgtccgcgttcatgacgaaaacttcgcgattactcttgttctccggtacactgtagtatgctactgtatacgcaattttctttccgtcgggcgataccgccagtcctccgatacgtcccattgcccaaagggcttcaggcgtcatacgcttcccttcgatcttaatatcggatttttcgataagcacctgatccgttttgcccgcgtcttttgttccgccgcaggcagctaacaacattgctgccgacatcataaatagatttgcttgtctcatattttataaaaatgtttattttcttgcgaagataatgaaaaaaggatttaaatctgctttttctgccagtttcctttcttcatataccagtagcagaagaggaggataaagattccatacacactttctgttgtccaggcaaacgcaatgtccattttaaggtaaagaataaaataagtagcgtaagctacataaattgtcagtacacaaagttccatggccagtgccgtgcgtgtgttacctgttcccgataccgactggaaatacacattggctggtaccagcactacgtaggctgcgcataacacccataaagaagggatggacgcatccctcaaatcgggcatatccgtgtatatgcgcagaattaggtcgggaaacagacagaagaatatcaatatcggcagtacgaacacatatccgatacggatgtgctgattgatggttccccgtacacaatctttttcgctcgcaccgataaggttgctgaccagagatccgcaggttgcagcaaaagccatggcgatcataaacgggatacccgacacatttcggataatgttcgcgatagccaatgaccgttctcccaggtgttccacgaacaggaagaacataaaccaggtagacaaagaaacgaagttctgaatcattgtccacacggagacattgagaatccgcttcaatgtccggctttggaatttcggcaggatattcagtgcatacttcttgcagtcgatccgcttccaggtatagatgataaagaaaatcatcgataccagttcagccagggatgaaccgatggctgcaccggcaatgcccagttgcgggaaaccgaacttaccgaaaatcagaatatagttgaataccacgttagaaagcaccatcacgatggagttcagcgtcagcgtcttggtctgtgtcgtaccgacaaagaaggcgcggaacatcactccgacaaatgagaaaaagaacccgtacacccgccaatgaatataactttccgctgcatcataaatgtgaggggacgaaatgatattctttaaaataaatggcgagaatacgatggaaagtgtaaacagaatcgcagcaaccactaccaggaaataaatcccctgatagaaaatcggtccgatttccttgtagtttccttccccgttgcgacgggcgatcaatatctgtgctcctacgctgaatccgaatgccatcatgaaaatagccaggtagtaaaccccggcgatggcggatgcccctaattcaatttccccgacacgtccaagaaaggccgtgtccgtcatgccgatcagctgctccataatcaggctgatcagaatagggtaggcgatcgtccagatttgtttataagtatattttgtcttcatattaagtttgttttttagagaaagaaagccggacaaacccctttcggttgcccggctttctcagaatatatcttcggataatttcttatcgcttattctgtttttgctgctgtaactgttcctgttgcttttgcatagcttccaggcgtgcagcaaatccggtctttttcatttgtttcgggtcttttttcttagcttccagaatagccagtaattttgtttcgtctgtagttttacgcaacaaaatcatggttcctacactaatcagtgttgacacgaaataataatagttcaatcccgaaggatagtcgttcagtacgaacaggaacataatcggcatcagatacatcatccatttcatcgcagccatttgcggttgtgctcctgtatcctgcatcgtcattgtatactttgtgttcaggatgttggttaccgtcatcagcaagcagaacaagctgagatggttgcccaggaacgggatatggaacgggaatgtgatgaacgcgtcgtaagtggacaagtcgtccgcccacaagaagctctgctgacgtaactcgatagcgctcggtacgaacatgaacaatgccatcaagatcgggaactgcaataacattggcagacaaccgcccatcgggctcacgccatactggctgtaaaggctcatcacctcctgctgtttcttcatcgcatcttcctgcttcggatacttcttgttgatctcgtcgattttcggtttcaatacacgcatcttggcagaagacatgtatgttttccaggtagcagggtaaactaccaccttcaccatgattgtcagaatcaacagtacgatacccatgctcaagccccagcccgacagccagtcgaatacgttgatcgtgataaactggttgatccagcggattaacggccagcccagatataccagtctgttaagttcccatttctctgtacgtcctttgtccagtgccttcaaggtcttgaagtggttcgggccaaagtagaagtacatttctgtcggttgttttccgctcggatcgaagaaggtactcatttctgcagaataatccttgatatatccgcttccttgttgttccattcttgacttcacagaaaccttgttgaagtcctggtctgcaatgaatacagaagagaagaactggtttttgaatgctacccagtctatcgctgtattgcccagatccttttcgtcatccttggcagccgacagattatctacattgtcaccttttaccttataagtcagctctgagaggcggttttcgtaagtgaatcccttttccagctggcgtgcacgctgtgtccagtcgatgtctacatactccgtactggccagtttgccttccatgcctgttgctttgatttcaaagttcatcaggtagctgttcggtttcagcgtatagataaaatcgatgtagctggcgttgtccgcagccagacgcatagttacgctgctgtctgtcttattgacagcttcgaagtaatagtcctttgtctggatggctccttgcttgttgtagaagttgaaactcatggtagcatcatcaccgtcgaacagtacgacagggtttgtcttgtcctgtcctttgtattctttcagtatggccgaatatacccgtccgcctttcgtagtgaaagtaatttccgctacgctgttctggatgcttactttggaatcagttccatgcatcgcgttgaaaaacagagcagaagaatctgctgctgccgctgcacctttgttttcattggcgagtgcggcttctgtttttgctttcagcgcttcctgctgctgttgcaccacggcaatagaatcgtagtatttcttctgcgcagctatctgctcctcgctcggacggctcagaaaactgaatcctaccaataatatacctattaaaacgagacctgtaatggtgtttttatccattcctattaattatgaattataaatttttgaataataaattgtcaatgggcaactgtcaattgtcaattcttctcgttctcgatggctgccttcacgaaagccacaaacaacggatgcgggttcaataccgtactgctgtattccggatggaactgagtaccgataaaccatttcaatgccggaatctctacgatttccaccaggtccgattcggggttgatacccacgcatttcataccggcagcttcgtattgagccttatagtcattgttgaactcatagcgatggcggtgacgttcctgaatatgttcttcgccgtaagcaaggtatgcttttgatcctttctgaagcacacattcgtaagcgcccagacgcatcgtacctcccatattggtgatcgctttctgttcctccatgatgtcgatcacgttgtgcggagtcttttcatccatttcgcgtgagtcggcatcggcatatcccaatacgttgcgggcaaattcgatagcgatacattgcatacccagacagataccgaaggtcggtatatcatgtgtacgtgtatatttgatggcaacgaacttaccgtcgataccacgctgaccgaatcccggaccgatcatcacgcctgccatgcctttcaaggcttcggctacgttctcatctgtcagtttttcgctgttcacaaagtgaacctccactttgcggtcgttgtaagtacctgcctgtgacaatgcttcacggattgacttgtaagcatcctgcaagtcatatttacctaccaatgcgatgttgatgggttctttcgtttcagcagcatgacggcgttccaggaatttacgccacggacctagtcccggagtttctcctacgggcagccccatcttttcaaggattgtgctgtccagtccctgtgcctgcatcaggagaggtacttcataaattgtttctgcgtcgatagactgcacgacagccttgtcatccacattacagaattgagctacttttttgcggagtccgtcgctcagcgggtgttcggcacgaagcaccaatacgtccggctgaatacctacactctggagttccttgacagaatgctgtgtcggtttggttttcagctctccggcagcggcaagataaggcacatatgtcaggtgtacgcaaagagcgttcttacccaactcccatttcaactggcggatactttcgaggtaggggagtgattcgatatcacctaccgtaccaccgatttcggtaattacaaaatcgaacttgtatttgttaccgagcaattttacgttccgtttgatttcatccgtgatatgaggaatcacctgaatcgtcttacccagatagtctccacggcgttctttgtcaataacacttttgtagatacgtcccgtagtgatgttgttagcctttgtagtctgaatacccaagaaacgttcgtagtgtcccaggtcaagatcggcttcatggccgtctacggtcacatagcattctccatgctcataaggattcaatgttcccgggtcgatgttgatatacgggtcaaacttctggatggttacattgtaacctcttgcttgcagcaatttaccgatggaggatgagatgatcccttttcctaaagaagaggcaacaccaccggtgacgaaaatatactttgtttctcccacagctataactgttttaattatttttacttagtagtttcttacgaacttaaaaagcgcaaaattataaaaaaaaggggaagaatgcagactttcccctctacaattttattaaaaaatgcaattttgaaagattcctatgttttctaaacaaaataatgtagatttgcaccaaattaggaatattatgagaagagagttattatcattcgtagtttttacctcgactttatctttatcgctttcagcacagaccgccactcaaccttctaccgtagtggcaaaagcgaaaattgtgaaggcagacacgctttcgtcagaacttcagaagtatttaatgcttaaattgaatctgtccggagaaactcctaaattggacactgtatcaatcttatataataagtatatcggtcagttggactatctgaatgacccgtctgtaccggaacgttatattccgtccgatcctgactattttcgtctgtttactccgttagcctattattatgctccgatggcgcagtattcaaaggtggactggaaaccggtacagtttgactctttgcccgacaacttgaaaaagttgacagcggaacttcttccttatgatactttggcatatacgaagtccgagcgtgccaatcaatcggtcaataaagcactgatggctctttatctcaatcatccggaattggttgtcaccacggaaaaccgtatcatgagccgtgatgtcttccgtagggatgtgaaaccgaagatttctccgaaggcatctgttgtccatcttttccagccggaagaaatgagcaacgatgtaggcaaggcaaaaatgaaaatcagccgtcctaactggtgggttaccggaggtaacggttctttgcaaatcagccagaaccacctttctgagaactggtacaagggaggagaaagtaactttgccggtctggctaccttgcagctttatgccaattacaatgataatgagaaagtccttttcgaaaatcagttggaggctaaactgggtatgacatccacaccgtcggataaattccatgattatctgattaataccgaccagttccgtttgtacaataagttaggattgagagcgttaaagaactggtactatactatttcttccgagtttaagactcagttctgtcacggttacaaagccaatagcgaagaacttgtttccgcattcctgtctccggcggatttggcagtcagtatcggtatggactacaaattgaataagcagaaattcaatctttctgttttcatcggtccgctgacttataacttgcgatatatcgacaattcggaagtagatgaaaccaagttcggtctggagaaaggcaaatgctctaaaaacgatttcggttctcagttgcagtcaacgttcaactggaaaatcatttcggctgtttcgctggaatcccgtctgaactatctgaccaattacgaatgggtacgtgtggagtgggagaatacattcaactttgttttgaaccgctatctttctactaaactttacgtacacgcccgttttgacgacagttcaaaaccaaccgttgaaaatggcagctttttccagctgaaggaattgctgagcttcggtattaactataagtggtaattttttttaggcacggattacacagatttcacggtttcaggaattgagtaactaaaaaccgtgttaattcgtgtaatccgtgccttattttatctctatgtcctcaacgttgaaatgatataccttcccggattatcaatctttccccacttggtggtagacagcgtgatccatatctgcgtccccttctttccgtaatccgacagcttgagaatagctgtaatttctttcttgtttgttactccatgttgtgccaggctgtccagaagtcctttgacgttgtgcgtactcttgttgtaggcataaccggggatttcgagcgaaggcgaagccgtattgtcttcttcctcttctgcttttcttttctctcctttactttgtccggaaatgtcagcaatttcgggtgaaatgttctcattttccagtttcaattcaccttgtactgacgaattgtttgcatcctttgtattattttccttttcctgtttttgggtgtcattgactaacaggtagggcaaatcttctaactttcttttcctgcggcaggtagcatctatccagatgtgctgaatttcaagggaagtcaatatctgaaacttctcatagctttctttgtcaaagaatcctttgtcaagcaaaatttgaatgattccgtctatctcttttcctttcagttctcctcccagtttgcgggcaaaaatcaacgattgttcctcaccccatgggatgtaatatccttctttgaatattttacatagaagtttgcatacagctccatccactctgataccatatttggcttcagccagttcaatggcatctctgtcgaaaaagtttacggtaagcggaaaatagtctacgcttaaataagttgtgctcatatcagtcttattgtttgtttttaagtttatacaattggtttccaatcgagaaaattctcaatctgaaaggttctccatcctttctcttccatgcaccagaatatgaaggtactgtgtacctgcttcatgtcataagagtggtgaaagtctttggaataagaaataagagtgcctgtaactaactgaaaactaccgttctgtctgtagtatgcgatgatggcatggccatattgcatgtagtctgccagtgatttcactttttcggctattcgttctgcgatcgtttccgaataacctttctctgatacgatacgttttttccatacttctgttaatcgatctctttcttcttctgttttgttagtggctatcagccgtttttcttttgtcattacattataaatttgttagtaaaatagttatatttaaagaaaaggcggaactatctgtaggatgcttacactatcgtgcgatgatagttacactatcctgccgggatagtgacactatcttgctgttatagtgacactataatttctgcgggatagttcgttcatttctttatctaaaaaacgggggcaaaagtataagttgtattttttcgctccaattattcttgctattttctactgtgatactttgatttgtattgttctttctcttctttttcgtgcttcgaaattattccgattcctttgcttaaactgctaatttcgctgagtatactcctgaatttcattaatctatatccatgatgtgtgtttacgtaaaagattctccagtctgcaatgtacttggctagtcctgttaaagattttacgtaggaattaaactcgtcatcttcgtaataagtgcgaagacaggcaatgaaatagtgttttttttcgcctgtgatgccatttctttttctgacctcatcgatgtcaataatttcgtcatcatcctgataatcagtttcaagacttctcttcttttgtgtgccagttgcatttttcaggcatttttttgtcgttgtcatttcttttgatttaaataaaattaataaatggcattaagatggaaattccaaattttcgccctataattgtatataaaataactagtgatgcaaataatgaataaaaatggatttagccgatgtggggaactatacatcggccttttacgaaaagaaggtcgtttttctacggcacatgtctatcaaaatgctcttttctcttttaataaattttgtggtaatgccagtgtatctttcaggcaagtcactcgtgaccgattgcgtcgttacggggaacatctgtatgattcgggcttaaaaccgaatacggtatcaacgtatatgcgtatgcttcgcagtatctataaccgtggggtagagttgggtagtgcgccctatgtacatggcctgttccgtgatgtgtatacaggagtggatatccgtcagaaaagggctcttccggtgagtgaactccgacggcttctttacgaagatcccaagacggattgtttgcggcgcacacaatcgattgctgctttgatgtttcaattctgtgggatgtcttttgccgatttggctcatttggaaaagtcggctttagattgtaatgtgatccgatataatcgaattaaaaccagaactccaatgagtgtggaagttttggatacagctaaggaaatgatgaatcagcttcgcaattcccagtcatcgcgtccgggttgccccgattaccttttcagtatcctttccggtgataagaaacgtaaggatgaacgtgcttatcgtgaatatcagtctgcacttcgccggtttaataatcatttgaaaagtttggcgagggctttgcacctgacttctccggtaacttcttacacgattcgccattcttgggcaactactgcaaagttccgtggagttccaattgaaatgatcagtgaatctttagggcataagtctataaagacgacacaaatttatctgaaggggtttgagttgaaagagcgtacagaggtaaatcgtaagaatttgcattacgtgaagacttgccctttaggtcgaatttgaatggttaaaaaattgataatcagcactgatgctggtgtgttacttcttaggtaacggaaaagtacacttcataataaatcggaaggaaaaagtcgaaaagtatcgactaatgagggttgagagcatcttggctttagaaaaagtagagattcttaggaaaattgggcatataaattcctaagcatgaaaataggcctttttcatgttcagatacattttttttcaaattcagggttaaatcgaaaaaaagtaggtttttatttgtttaatacatgtgtttttgtctatctttgcgtcaaatttaaatccgttacctaagaagtaacggaaaaacatggggtaaaaaagtatgattttaacaaaagagaaatcactaaatgctgggcctatttatgggacaggggaaggcgtagcacactcaaaacgctggtatgttgcattagttcgtatgcatcatgaaaagaaggtttccgagtatttgaacaaggtggggattgagaattttgtacctgttcagaaggaaatccatcaatggagtgatcgccgtaaattagttgaatccgttcttcttccgatgatggtttttgtacacgctgatccgaaagaacgtatggaagtcctgaactttactactgtgagccgttatatggtgatgcgcggtgagagcagtcctgctgttattcctgacgaccagatggcacgtttccgtttcatgcttgattattcggatgaaacagtctgtatgaatagctcccctttggcacgtggtgagaaagttcaagtaattaaaggacctctgcaggggcttgtgggtgagcttgtcaatgtagatggtaaaagtaagattgctgttcgactgaacatgcttggttgcgcctgcgtagacatgccgattggctatgttgagcctataggtgaaaaaaactaagtgggtaatgacgacttcctgtttacaagaaaaaatcgataaacttcaaaatacagttcatgctctgctccataaaagtaattatatggcgggtgtgtatgttgatgatcttgcacgactgaacaacgaaatccatgaacagatcaatgatctgtatccttgtcacggtaagactgctgagcaggaagctgctttgtgtctgtctcttctgatgggatatagtgtgtctagcaaagatcgagacttaaagatacaaagacaacgggtactttatcgggggcttactaggcatccattctctttctttagctaatattttattaagcaatacactatatttaggctcaatctctttggcaaagtactcacattctaaaaaaagaggttctaattgattttcacaatatgttttaggcaatgtgtaaaagtctttaatacaacaagttttatttatagcttgaacatatgattttgaattatctttgttatatacaaatagataagtaccattttcagattttttttttaaatagcattgtggtatataatgatgagacttatgggcatttttatccatatacatttattatgtttctaatacttctggggaaagtgcctgtttccccattaatatctatttattcataaaattttcttaatatcctcaacaatgattggagataaatctaattgctccaagtcttgttcctttatccaactcaagctctcctcttttgacatttgagtatcgattatataatttgataattcaataacagtgttacgactcagtcccaaagagagtaatgaaagatgcgttttttgagaaacaccaaactctaaccacaaatttaattggggaatatcattcaatagctcatgtttattgtgtagttctaaaaaatatctcaaaatgtctatatagcaactggattctttcgcaaacttaaatcttacaaatttctcaacatcatccatgacctctctaatcacaacaggaagtcttttatctctatatttttcaggcttgctttgataatacctatatctagaactaataagatatgataatggcataccattcatccaattggtaagtaaaattgctttagaaaaattttgctgtggtaagtactctgaaatagttttacctatccttcctacaaatttagtatattcatcatttgctttttcatcattcggatatacagggattaattcctctatgcgctctgcattctcactaaaataatcaaataatttttgttgagcaattggagaaattcccggatttcttttaagtatgtaatctggcagcaaaatagtgggggctatattttttaatttagaatacaattctttttgaaaagtggtttctagaacaatatctttattcaaaatatactgtatatagtaataacaaaatgccgattctaagtcttgtcggttatttgcttcatttctgggagaaccgtcggttatatatttcaaaagttcatcccctttctcctctataatatttattgctcgttttattacttgcttagatttattcgggttaggtttgattttccataaatttggttcaatacaaattatatttccactaaattcttttccccaacgacctgcacgcccagccaaattccaaaaatcatttgaatttaatggcttatttctaccgcgtgttggttttcttatgacgattgattttgcaggtagattgactccttctaataatgtagaagtacacactaaatattttattttacctttcgtaaagagcttttcgatttcttgtctaataagtaaaggcatatttccatagtgaaaagcaactcccctctcaagaacctttgctagagcatattttgagtgaatagtagatttcaccagtttaattaattctgctatttcacttggtattggttcttgagtaatattgttatatagaagtaatgatatttcttctgcctcagcagctccgttacaataaattaaactaccactctcacactctgcaagttgttcagatattaaagctattttttttaactctcctgtggggcgatcttttaaagtcaaagttcctataagaattaacttctcaatagtgcatatatatagttgccatatctttggctttcttggatattgcgtagcatatattagattttgattaaccgctacaaattgtgtattaaccttatctttctgactattgttctgtacattgtctaacaggatctcagggttagaggtgaagggacttgagaaatagacttttatatcagaattatgttttacaacttcctctattttttgttgaagtaatatccctctacttccatcttcaattttatgggcttcatcgactataagtaaatgtaatggaatattaggattatctgcaagaaaccaatgtagtctttcttgagtaaaaataaaaatatttgatacattttcactcatattatcttgttgaggtacagttgatatattgacagcttgctctaattgattggctttgattagttctcttaaatccgtttctacttgacttatcaatgctcgtgtaggaactaaataaacaatatttttatttgcagttaataattcctccaatagaatattacaaagaataaaggactttcctgctgaagtaggagcggaaattgaaatcgtatcatttattttatgagcatcgtaaaccgttttttgaaatctatttaatgcaattattttgtctttaataataattgaatgctcaaaatcagtcttaaatctctgtaatttaaatgcaatgggataatttttttcataatcagggttaagatattttttatccttagccatttttattgccaatttatttgttaagctatctaaaacaactgctgaagcatttttctgaatttccgaacaagaatcttgagtgaggcaagtttgagcgatgcgtaatgctgcatctaaatggctactttcgggtgaataactcaatatagatgctatactcaaaagattattccaatctatttttgctaataatgattgcttatcctcttcccagaccagttgaggtattgtatcacacaccgacaaaataagaagagcttcatattgtcgtttaaaactatctaaattgtaaactttttctgcaatcattattgtatagtacttaaataatattccctaaacttagcaactgacggaaatggcattaagaaaacatgtatttctttggtatcaagattcgtatgcaacttaattttatcacccaaactattgtaccacttttgatgctctgtagttattgcattctttatttcttctgtggttttagacaagtcgccttctgatggatatttgttgcaatcaaatccaataaaacagattcctttatatacgaccttattagagagttcgtcatctttatcaaaatatcgtactaaaaggtcttctaatgcattatcatttatattcgcttgtatgttggatgtaattaattgcaaatcgcgctcttgagtagaaccatacccttggggatctaacagaaaacctttcaaacttttaaaacactctgttattgcagagcctaattcttgatacatttttgcttcagcccaatataaattcaaacaatctgaacttgcatcatatttcacatgtattccatcagccccttgataatgtaactgcccggatgttttcaatgacattttactaatcaattgtggtaattgaagaaactcctgaataagaatatataacaatatttcaccgccttcacctgttttctctaaatctgtaaaaagtccctttgcctttttctttaacaattctatctttgacggagaatttgtatcattgaaatattgtttagcttcatctatttcttttttagggatagcatattcaattattttagtatctatgaagtctattaaatcttttagccgtaaattcccgtttgcgtcaactttaaggcaataacaatatccttttgcctgtgtacctgaaatatcgacacaaaaagagatttgttcaatgcgagagtttatttctcctcttgactgaacaaacaatctattcaaagcctcttctattctactcatatgatttaatataaaattcgcgacaaaaatacaaattatattccatatacatgctaaattactcatttgcaagtaaaaagattagttgttagcgactccattccaatatttccgattcccagtatagtatcttccccttaacctaaataaaaggaattttcttcgtttaggtgtgaagtacggttttgcaaggcttgttgaatagtgtttaaaagctcgtctaaagccttaaaaagtaagccgatttgcgaatatttattgtcgagaatatccaaaattcatttattgttagcatatccagcttttggcaataggtaatcaaagctcgtttaccattgaggtacacaaaataaccctgttcaccctcttgaagctcgtacgttgatgaacttaactgtttggtgacttcattcaaatagataatacttaactgatagctctcatcgttcttgtaaatcatcacggttgggtttaggtttatactttcccaattcctgaccagcatatctaaattaaaagttctattttcatggttgttatttcttggtttgttgttgattagtgaatagttcgatatcggtaactttgtaataacacttgcgaacgatttgagaataaggtaaagtgttggtatttagataagtttacagggtacggagcgagattttcagtagttcgcaaatttgcttgttgtctaacccattttcagcatttctattctgtccgtagagtgcatatttatttgcttggcaaaattctcaaacctttgcatcatctgttcaaaggtctgtcttttcgataattgtaatttccatattgatgttgttttagattgttataaacacctatcattacaatgatttgctacaaagaaaaagaaaaaacatccgcttttgatttttataaaatagtttcttcattcagtctttgtaaatatgccatcttacgccaaatcccgccattcattcagtacatagataaaatcataacatcttattaattaaacctctacattcgctccgacgggctaaagtttacccggtattgattaactattgtatcacttaaattattgattttatggctaagaaaaagcaagaacaacatgaacagagtcaggacgagcatgtaatggccatccttgacaagcggacgaacaagaccgcagtcgtttccaaaatgaacgagcaggacggcagtctcgaaatcgtgccacccgacaagaagaacagcggcagctttctcaaactggatcgtacttcaccgctggaactattcttcacgaatttcaaaaaccagtacgaaaatcccacgagtttcagttttttccttgtacctctcgtacttttggaaaagacactgaatgccgtcatccagatccggaaaggggaagaccccggagtggaaaacaaaaaactggtagagaacagcgaactcaacgatgaagggcgtatcgccaaactcgcccgccggtataaattcgacgaacaccagcttccgtggaaagaactcgccgcattgggagttgacaagcaactcttgttcgataaccattgcatgggtgagatgctgaaagggagaattacctcgatggctttccctatcagcaaggaagtgaacggtgaaaagaaggatatgggggaagcctgttttctctgtgttaaaggggaggacggcaagatacaactgaaaactctaagcaggcttgacaaaccgcagtatgaccttccgacctataaaggagtattcacggacgaggaaaagcagtcgcttaaagacaccggaactttgggggcagtcaaggagatgaaggatacccatacgggaacagtctgcaattgttatgtatctttccatgaaccgagcaaccgtatcataaccatgccggtggatgccatcaagatacccgattatatctacgggaaaaggctgaatgacaaacagaagcaaatccttgcgtcaggaggccagcttcccatcaacgacatacagcgcaaaaacgatacgctgctttccggggttgctttcgttgatccgagaataatggacatcgctttcaagcaatccggtgaacaactgaaggtcaatgacactatcatgggtgccaaaatcacacctgagcaaaagaagatgctccagaaccatgaaatggtgttcgttgagaatatgcgctacaaaggcaaggtattttccgatgatgtacgtttcagtaacaaaagcaaccaactgctgataggacgtaacgcccgtgaatacaaaccgaagttggatgatccgaaaaaaggcaaacaacaagaaaccaagcagacgccccggcatgttactgccttcaaacctaaaggcaagaaaaatagtttttctgtcgcatagccgacagggaaccggcttactcaatttatatacccgattgtcgttatggatgtcgggtatatatttaatgtatcatctaataacccaataattatggaattgaaaaaacaaaagaatagccagtcttctccggagcattccgaatataaatcattttataaatcagtcggaggaaatgaaggagaaaaatgtaattatccgacacgtttagacctttacggaaaaggctgttatcatgattgttcctacttgttatgcaaaatccttgttgaacttccgcaaactatgagatgcggaacattcggcagtcgcggatattaataaggtattaaagtttatccgtaaaaccccatccggttccatcgtcaggcttggaggtatgactgactgtttccagcccattgaaggccgctgccacataacctatgaagctataaaggaactgaacaaacaaggcatcgactatctgatagttaccaaatcatcaatggtggctgatgataaatatatcagattaatggacaaaaaacttgcacatatccaaatatccataacaacgatggacaatgacctgtcacggacatatgaaagagcctgcgtgccgtcacaaaggataaatgcgcttgaaaaattacaccaacataattttgacatatctttaagattatcaccttttatcccgcaatatatagatctcaagaaattgaatacaatcaaatgtgacaaaatattagtgaaatttctaagagtgaacatctggataaaacaatggtttaatattgactattcggaatataatttcaaacaaagcggctatcagcacttatcgcttgaactgaagattaaataccttgatcaaatcagcggatttaggcagttgactgtttatgaagatgtgacggaacattacgaatactggaaaaacaaaataaatccgaatccacttgactgttgcaatctcagcggaaaataaccttaatatataagtatgtttcccacggcacattgctgtaacccgcggaagctgcgcaggtttcacttccgcgggttacagcaaagagccgtttttcaggaaaggacaaaggcatggccggcacccggataaatccgaccttgcccaccgtgcccttgtctgtcagccataagttacatcaatcctctttctcgaaggaaaggctttccacctgcctgttgattaccttccagtcaatcgaatctttcaggttgataatatccacaatcgaatagtgctttgtcccgttctcttcttccgcaaaacgcaaccgtccgctcaaacgctgtttctcaatctctgccggatcgagatttatcagttcgcagacttcatcgggcagcatggaaagcgccacatcattttcctgacagatatgttgcaggacggccagcatgttcaacgacttcttataacttctcacgagcgcagcgaatgaactactttcaattttaatcatcttcttcataacgcttattttttagagtgttcttctttttccagcaacatggcacgaagtacgtccgaacgacggtaatatatcttccccttgtctctgtaaaaggggagtgtcccgtcattgcgtcgtcttaaaagtgtcctgtccgacatcttggtaaggaggcgcacaccttttgaatccagtatctcactgtccggcaaattatgtacggcaggagccaataacttttcaatgctggtaactttggcaagtatggcactaagcatgtgggttgtttgtccacccggtgcagttcttctgttattcataatgaccttattttattgtttatagtgcaatattacggagatattataagaccattggttactcaaccgttgagcaaccgatcggaaataatatccaccacccaataatagtcagagaataagtatcaagataccctgatttataaactgacaacctgttcaatataataatttatataaagtcaatttgataattcgaatgaatatacaaattgtatgcagaagtatagattaacaacgtttaatcctaacattcagcatgttaaaagcatatattacttgtattttacaatatcaataagaactgattttgctactgattacgatatttcataatgcatgcggaaaaacagataatgttaattaattaaaatacatataacaagatgtagcttaagagtggattagtttgtacttttacatataattgtgaaaacatcagtatatgccaattatagatttaaatcatagagtttcttccaattgggatggggtacataggtatttaaaatctccagatagttgtgtttatgtaaaggacagagcaattgatgagacgaataatcccacctcaatggaggtagaggtgggtgatgcatatataatcccaggtgacaacaaacagtataaaattagtgaagaaggactaaaggtcccttctagaaattctgttgtgctctatagtaaacagaaaataatgctcccttataacgtatttggagtagtaacagggaagggcaatttaattttccagggttgttttatatcaacaggaaaaattgatcctggatttgatggctatctgaaaatcggattttataacggtggaaataaggaagtcgttttgaggaatggagagaagtttgcttcactattttttatatcaacggaagggactttggaagctccccttcaaaactatcaatcagccccaccagctctattgaagcatgtaaaatggtatacaagattatggatttggatgaaaagtaatcgtgtctctctaatcacatggctctttgcattacctgccgcccttcactattcaaaggatgttgttaattttttaatcaacctgttcaaatgataataactggagaaaatttaaaagatcttatccatcaacatgagattgcaaatgagaatacatacgatattttctcacttacacttacaatggaccaacttgtaaaaagatacaatgtccctaaaggtgaatacatatcttatggttcccccatccaaaatgattatattgaaactatattattaaaagatgggtatattttacatcctggtgatgcaatccttgcatgcagtgccgaaattattaatatgcctgcagggtatataggaatagtgcaaaccaaaggttcattagctaggttatttatttctgtacattgcagtgatggacaagttgaatctggctaccacggcaaagtgacatttgagatatgtaatttaggaaatattgccgtaaagattagtagcggacaacctattgcacaaatatttattcttgaaacttcatcagtttctgtactttatgatggtaaatacaacaactcaaaagaaccaacaataagtaatttcaattataatatatgaaaacagagatgactcttgctgttccgactgaaaaggtatggcaaatattagaatacaaagcgaatgctgtaataaaagttattgatacaactgacatggaaaaattactttccaatggaatatttgaacatcgcaatatcttagaggaagatgttacacataagcaaatcattccatatgcggttatatgttgtaacgatgatgtgtatctcttccatcgtaccaaaaaacaaactgaaacacggttgcataatctctattcgctcggtgtaggagggcacatgaatccttttggaaacaaaattgatgtcgaatatctacatcatgagctaaaacgcgaaatgaatgaagaagtattcattcatgcagattgtaaggtcaaggaaatcacgcctattggctttatcaatgatgatacaaatgaagtaggtagagttcaccttggagttctttttcatatatatctgaataataaaaatattgaagtaaatgaaaaagaaaaaatgaccggaaaatggataaataaaaatgatttaaaacatttttattctcagatggaatcttggtcaaagatttattgtgacttacagcagatatgagagagtataaaataataaagtcagctccctactgttgtgtatgcgcagcagtagagagtatactaaatcgtcatggttacactcaaaaccagtatgacttagctaattatgcaggcattacagtatctacagatgattttctgactttacctaaagaattgacaaatgtaaagacttcaaatgttcctttagattgggggctacatctttatgataatacattaaatgacttctttttgcaaaatagtatatctttaaaggaaacctttattcctgcaaatcagctaaccgattggaatatcgagtcaatgtttgatgcagtagctgaatcttatgatatactattattctttagtcatggaatcctttacaaggaaggaaaaaataatgaggttggtcattgtgctctatacatagataaaaaggataattatatagtctatcaggatcctggacctagcaatctaggacttaattcaaaaaatatagattgtatgttagatgctatcaagtatagagcaagagctggctcgggtatatcaataataagcaattaccactaattctttattaggttatcctaaaacgaaggagaatctttatcaccaaattgttatctgcaatattaaaaatagatatataactctcaagttgcaaatcttacataatagataatataatccctattatttacatctgaaattaaaaatatttcagtttgcaattattgaattaattttcgtttgacaatgaaatacttatcaatttagtagcaaattccaataaaagtagctatttttgtatcactattgaaagccgctatagggcccacagcaaaatgcagaaaataatctgtggtgaaataggtggactaaaagaggaaaactttataagcatctacatatcaataagatataaatgagtggtgaaccccaggcggatcacggagtaaaaaacctctgataatcattgattatcagaggtttttttattaatatacacagaacatagatataagactctacataaagcccaaaacatatccaatatcgaatcgatgacaaacagacctacaccaaacaatcggctcatagaatgataaacttctttttccagttattgtttccatctttaccttatatattataaaagcgcggcaaagatacaactttaagaaatagcggaaatgaacatttgttaataaaaagatggctattccggacaactgtttactgaaaaaatagcttatttttgcaaagaatgcaagattagtcaaatggttgaatcagaaataaataaaagatattgccaaagctgcggaatgccgctccgcttcgacgtggaggaatatttaggcaccaactctgacggttcgaggagtgatgagttttgttattactgcctgaaggatgggaaatacattgttgatatatccatgtgggaaatgatcgacatctggataaaatatacagataaatataatgaatacgcagacacggactattctccgaaagagctgagggagatactggacaaacgccttcccacactgaacagatggcggcaaaagcaagagacaagcagccttcatcataagatgattcagaacataatagtgtacatcaacggtcatctgacggaggtactgaataccgacacgctgagttcgatgagcggactgtccaaatttcatttcagaagagtgttccgcaccgctaccggagagaatatcggcagttacatacagcgtttgcgcatggaacacgttgcacatctgctgatctctacggactatacgctaaagcaaatcatagagcaaacgagttatcagactaaatacagtatcgccaaagcttttaagaaacattttggtatatcaacttctcaatacagagagaagcacagaccgaacggtgaaaatccggcaacaaacataaaaccggagataaaagtgatcagcccgataaagatattctgcatcgaagtgggtgaagcgtataaaaacaaactaaaatacagattactttggaataaactactgcatcatgccgaacagtatgaagcagacccacgatatgacaagtttatcagccttagcatggacgatccgtcgattacgcctacggagaagtgccggttctatctaggcatcacccttcgcgatgatactaaagcgagaccggtaccgggaatcatgcaaattcccggagggcgatatgccgtgttcagacatacggggagctattcttctttacacaaagtgtacaggagcatttatgaggaatggtttccgaaaagtaaataccatccccaaagcacattcagctttgagatgtatatgaatcatccgtccaccacggaaacgtcggaattactaacagaaatatatataccggtcatacggaaataatcaccattaaaacagaatctatggcaaagatatcagaaatcatgcttttacagcagccggaacagcccgctttggctattgaagtacaaacctacatgaaaggtatgtcacaggctatcggagagaattttgtaagaatagactctttattcaagaaacagggagaagtaaccacggatatccccttcgtagagtaccccgacttcgaaagcctgaccgaagatcgtataaaaatgattatcggactgaaatcttcgaaacctttacaaggtgacgaaaaaatacaatctgtcatcctccccgccagaagaatagtcgtatgtctgcacagaggaaattacaatgaactggcacagctgtacaatgagatgaccgaatggataaaaacaaatggctacaaggcctcgggaacatcaatagagtattattacagcaatccggatgtacccgaagaggaacatgtcacaagagttgaaatgcctttactctaaaagcaagagaatagttgccgtaaactcttaccaaacaataagaagcagagaagccgtcatacagtatcaccttgtctgataaagtaccggcattccctgcttcaatagttctttagaaattagccttgcgtttcttcacttcttctacgagtttcgtaaaggatttctcctttttacgtttttcatgttcggaagcggagaagtgccatgcttctcgtctgagtttcagataactctcatataccttatgatctaacgtaccattatgtaccgcctctaaaacagcacaacccggctcgtcgatatgtttacaatcgctgaaacggcatgattccgcatagtcggatatttcaaacatttcggtgagcgaatcgggattgtcaatcgccaaaccaaattcccgaacacccggagtgtcgattaaaacacctgagccgtccatcaataccatttcccgacgagtcgaagtatgccgccccttccctgtagacaggcttatatcagaagtattcaataccgatttcccgcaaagggcattcaccaaagaactcttgccgacacccgaagagccgacaaacacaactgtttcgccttttgttatggattcccgcaaccgaagaatcgtttgaggttgacgaatacttgtgataaatacaggaaactgacgggcaatgtgtttgatcgcttcatctattttctgtctgtcacaacctaaatcggctttattgagcactaataccggtttgattttttcttccattacctgggcaatgaaacgttccgccctgcgaacattgaaattatcatcaaggctttgcacaataaatgccttatcgacgtaagaagcaatggcctgccggtcggctacccttccgttcttctttcgatacaacgcccgttcacggggcaatatatcaactataatccctttgtttgcatcgaatggctgaaaaatcacccaatcgcccgtacaaggatattcatcaggcactctgccataaatcatatttcctgttaactcgcacaaatatacaccatcctctgcaactacttcataacaggttttatgtgtcacgatgattcgtccatgagacatatctttatattgtgagatttgtttttgccggaatagattatcactccaaccatataatgacagattattattttcgttactcattattttaatgtatatagcatacacgtaaaagcacaacaatgctttcgctattgtatgcgggtataaaaactaaagttatataatataggaaaatcacttccggaaagattatccgaaagtatggaagttcgaatctgttaaagtgaacagattcttatcagaccaaatccgatgtaataaatgatgagttaaacatccactagttttaatgaaacattataattttaatgcgtcaaagatatgagaaataaataacagagccaaatgaatgatgaaatatgtgtcaaaagccaatggatacgcggcctgacgtttccattttccattctcttgattttttgtcgtactggtattccgcaccgacacttacttccgtattctttttcacatcgaccgagatagaggctcctacccctgtatgtggaaataacggattataagccggaggaggtgtatttccccccataaaatattgtccccagacatttaaccggacatttctgactaaagaataacgcattctcgtatatattcccgctatatcttgcctcgctataggcaaagccaaatagaattgccgactcaagtcccctcccgcttcaacgaaaaatctttgagaaggaatccagcgtattccggcatttaccgctacatattgccccaatcccagataagtcttttgttctgcactcccaataaaggaaagttgtccattcatagaatgctgacgaaaattataaaaatccgtcaatgtcggattactttccagcaatgccggaaaatcgtaagaatagggagataagcccgatgcaggacttgaaggtgtcagaccgtatgtctgcatggacttatcatctgttgcgagctttttagcctctatatccggtaacttcggttctatgttttttgcttcgggcaactgccgtccgctcacttccgcggagctatttttcttttgcacatctattttattctccttttctatagtttgagaaaaggcagtagcaacacaagcaaaagacacaaaaacaaagacagcaactgttctaatcataatattctcctttcttttatcaggggctatattattaatacaattatccggttaaaagctcaatgatcggtaacatattttttattttaaagtagagatagattgatagacagcttttgccattacctgcgctcccttttcgttcggatgaatacggtccggaaagagttcgggcattccgtccatagcagtatggaggtctataacagacaggtcgtttttcttggcgagcttcttgatcatcggaatgatttctttagagataatatcatcgttgatgccgtcacctgtcagataagctttggaaggatagcagagataaatcttcggctgtgaaggaagacctttgaaagcgtcgatcatggtctgcgcatctttcatgaagtctgctttgtatttccagttgaatgatttgctgtcgtttgtaccaagtttgataacgacgatattaggattaaaagctaacgcattcttataagcaggttcgttcatataaggatgatctcctttgttcagcatggtacgggcgctcactccgaagtttttcacccagtagctgtcgcccagcatacgggccagtacggaaggatagctgtcgcggctgcgatttcttattcctgctccgaacgtaatactgttgccgatgcaagccacacggacggcatctttgcgaggagccttgaaactacgcaaccaagaagtcagttcgttctgcatttcactcttgtagaggaaatcttcacggattccccaaccgtgtccgcctgtaggataaatatggagaacggaaggaacacctttcttatttaaagccagataatagttgactccgttggcaggaggaactaccttgtcatcatcgctataaacaatgaaagcacggggagtctctttggtcacttgcttctcgttggagaattctttttccagatcggcagaagcgtccttgcccaacagattgtcatgagagcccatgtgagtgaaagatttgtccatcgtgatcaccggatagaagagaatctggaagttgggacgaagtgcttcaggcgcatgtgtagcgatggtcgaagctagatggcctccggcagaagaccccatgataccaatatcattcggattcagattccatacgtcagcgctgtcacgtaccattttcatggctgcttcggcgtcggagatcgggagggtgcggtcgcctttcggcatccggtatttgagaacaatcaatgcaattccttgtttgttgaaatacggcgcccagtcatacccttcgtgattgaccgccaagccggagtatcccccacccggacaggctaccacagcacgacctgtcgccagttccggtgccggcaggaaaacacgaagagaaggctgttcaatatcaaatggttttggcgtactttgtgccgagacttgcagtcctgtcaatagcaggaccagcaatacaaaaagagaagagaatttctgtttcatagtatctgtatactttgattaatgaatatttgatgtgcgaagatagtaattttatgtatctttgcgcctccttttaaatagaaaaaatgatatgcaaggaattaagaatctgacacacggccctatcaaccgccaacttttcaatctggcgatgcctatcatggcaacgtcgtttatacagatggcatacagccttacagatatggcatgggtgggacgactgggcagtgaggcagtcgccgccatcggttcggtaggaatcctgacgtggatgtccggttctatctccttattaaataaggtagggtccgaagtcagcgtaggtcaatccatcggcgcgcagaatcaggaagatgcacgccagttcgcttcacacaatatcacgattgctctgatcatttcgatctgctggggcggactgctgttcatgttcgcaagccccattatccgcatctatgaactagaagagcacatcacagccaatgccatcgaatacctgcggattatttccaccgcattgccgttcatattcctgtccgctgccttcacaggtatctataatgcagcgggacgaagcaaaattccattctatatcagtgggacgggactgattatgaatatcattctcgaccctctgtttatcttcggcttcggtctgggaacaaacggtgccgcctacgctacatggctctcgcaggcaacggttttcgccatcttcatctaccagctgcgtttccgcaaagacgccctgctcggtggtttccccttcttctcccgactgaagaaaaagtacacgcggcgtattctgaaactaggcctgcccgtagctaccctaaacacactgttcgccttcgtcaatatgttcctctgccgtaccgcatccgaacagggcggacacatcggactgatgactttcaccaccggcggacagatagaagccatcacctggaatacctcccaaggtttctccaccgcactcagcgcctttattgcccagaacttcgccgccggacgaatagaacgggtactgaaagcctggcacaccaccctatggatgacgggaatcttcgggactttctgcacgctgctgtttgtcttttacggcaatgaggtcttttcgatctttgtccccgaacaggcggcttacgaagccggaggtgtatttctgcgtatcgacggatattcgcagctgtttatgatgctcgaaatcacaatgcagggagtgttctacggcatcgggcgtaccgtgcctcctgccattgtcagcatcgtatgcaactatatgcgtattccgcttgccatcctgtttgtacggatgggcatgggagtagaaggtatctggtgggcagtatgcgtcacaacgattgccaaagggctgattctcctgggatggttcaccatgatcaggaaaaaatgcttaaatctgccttccgtgtcaacaaggtagccgtgtcgtttgttattttacatatacaaagatcatccggagttattttaacctaaaaagtatgaccttggcaaataatatgtatctttgcgttgttaatttattaaagtattattttataaacctatttaaaaaacattgcattatgaacaagatgaaatggatggttctcttcatgagtataaccatgatattcagtggctgcgcaagcatgaacaatacgggcaaaggtgccgcaatcggcggtggttcgggtgctgcattgggtgctatcctcggcggtgttatcggtaaaggcaagggtgctgccatcggtgcggctatcggtactgcagtaggtgcaggaacaggtgcccttatcggaaagaagatggataaagcggcagcagaagcaaaacaaattgaaggcgcacaagtagagcagataactgacaacaacggattgcaggcagtaaaagttacattcgattcaggtattcttttcactaccggtaatgcgactctgagtgctgctgccaagtctgcattgagcaagttcgccaacaacgtactcaaccagaacagagacatggacgtatccatctacggatataccgacaatcagggctggagaaacagtaccgccgaacaaagccgtcagaagaatctgaacttgtcacaggaacgtgcacagagtgtagccagctacctgttaaactgcggcgtttcttccaatcagattaaaggtgtgcagggaatgggcgaaagcgatcctatcgccagcaacgacacagctgccggaagagaacagaatcgtcgtgtagaagtttacatgtacgcaagtgagcagatgattaaagatgcacaggccgcttccaattaaaaaaatattgcgttatgcgcgcaacctgctgattttcttctttgcatctaccattctggctgtgatcgtctaccgctttatgccggtgtatgtcactccgctgatggtcatccgaagtgtacagcagcttgcgtcaggagataaacccacgtggaaacacacgtgggtttcttttgataagatatctcctcacctgccgatggcggtcatcgcctccgaagacaaccgctttgccgaacacaacggattcgatttcatcgagatagagaaagcgatgaaggagaacgagaaacggaaacggaagcgcggagcaagtaccatcagccagcagacagccaagaatgtgttcctgtggccgcaatcgtcttgggtacgcaaaggtttcgaagtttatttcacctttctgatagagttattctggtcgaaagaacggattatggaggtatatctcaactctatcgaaatgggaaaagggatttatggcgcacaggctaccgcaaagtataaattcaacacaacagctgccaagttgagctcaggacagtgcgcactgattgccgctacgctccctaacccgatacggtttaactctgcgaagccttcggcttacctattgaaacgacaaaaacagatattgcgattaatgaatctggttcctaagtttccgcctgtagagaagaaggcggtcgataagaaagacaccaggaagaagaaaaagaaataaagcaatccctttatcacagtctatttcatcaagaaacaagacaaggataaagggatttcttttttccgttatttaagatacagactatgccggttcctcacacctctcgatatacgccaatggttcgcctttatctaccaatgctccctgcttggcacatacttcgatcacacgaccgctaaaattcgccaacaccttatcatatgtatgccaaggagtagcaatgtagcagaacacatcgtccgggtcatatttatgtcccacttcgggcggcatagaaggcgattccacatcaatctcccaaatgatctgacctttctccattgccgtcaccggttcggccttggcacgtttcatccgtttcacttcttcttcggagaatccctgttttgccaatgcggcatctttggcacgctgcaaatcatcttcgaaacgtttcttggcaatacccgatttataatcccgatattggcggtcgtgcattgccagttcgaagagttcttcatcatcctgtccgaagtcccagccgttttctgtcatttccttacgatactcgtccagctgatccggatagttcttctgcgggtcttcgtccgtaaattcgtatcctttttcttttgccagtgcgataatctccggagcaagtgcaccgggcaaacgaccactcttacccagaatcatatcccaggtatggttgtcgatcatcgtccaacgctcctctcccttgatcagagacatcacattcatcaatgccacattcttcacatattggctgaacggagtcaccaatggaggatagccgagtttcggccacacatattccacctcgtcaaacagcatcacgagcaaatcgtcgatactcagttccggttcgttcttacctctcaatatcagattgatgccggaatgtactcctttcagatcggccatcatagaacccatcatacctccgggaagtccgcatttcaagagcaaagaagacatatgcttgttggtagggtccataaaataacccagaaaatcgtcaatgaactcctgtgtcatggcacgggctttcatgtaggctttcatattaatctccggtacctgaaatcccgcgtctttcagcatagcctgcacagagataacgtccggatgaactttcccccacgaaatcggctccattgcgacatcaataatatccgcgccattctcacaaacttcgaggatagaagccatcgaaagccccggtccgctatgtccgtgatattggatgatgatttcgggatgccgttccttgattgctttcgtcagacgtcccagcatttcggggcgaccgacacctgccatatctttcagacagatttccggtgcgccagcttctatcagacgctcggcgatggcggtataatattctacggtatgcacgggcgagaacgtaatacataacgttgcctgcggaatcatccccgcttcgagggcataatgaatggaaggaataatatttctgacttcattcaagccgcaaaagatacgggtgatatccactccctgcgcatgtttcactttatacattaaccgacgcacatctgccggaacgggatacattcgaagaccattcagaccacggtcgagcatatgagtttgtatgctggcttcgtggaaaggtttcgtgaaagcccggacggctttgttcgggttctcgccatacagtaggttgacttgttcgaacgcgcctccgttggtttctacacgggagaaacaacccatttcgataattaacggagcaattcttactaactgatcggcacgcggttgatacttgccggacgactgccacatatcccgataaacgagactgaatttgatttcctttttcattgccgtaaatagatgagatttatattacttaggttaactagttgatacaaatatattgagttttctgacataataacaaatatagagagaataagttggggtataaagatatgtttaatatcatattgtcacaaaatcaaaggagcaagcgagtttttactcgttgctccttaccagaattaattgtttgactaatgtgttatccctatttatacaaaatctttcaactcttgttgcaaacgttggcgtgtgaagaaaatgcggctcttcaccgttccgaggggtaggtccagtttctcagcgatctcacggtatttaaaaccggatacgtgcattgaaaatggtactttatattccttcggcagcgcgttgacgatgcggtgcatctctttcaagtcataagcgccttccgtactttcaaatcctgagtcttgggggagattcaaatgatacagattgtcggtctgatctacgaatgtctggtcacgtactattttacggtagttattaataaagatgttacgcatgatcgtgtacatccatcctttgaaatttgtatcgggaacatatttctcctcgttatccaaggcctttaatgatgtttcttgcaataaatcatttgcttcttcacgattggcagttaatttataagcaaaacgaagcaactcttcctgaactccaattaaatcttttctgaaacttaaacttttcatactttaagggttttacggttaatatttcgtttctttcttgacgtttgcaagtttaaaggtattttatgagtcgaacagggggaaattcgtcatttcttagggggtgaaactgtcaaatgatagattttaggtgctttttgatagtttttaggtggtttaggacgttttttattctcttcttcttgtttggcaatacaaaataacttacttttgggtagtattattaacttaaagtaaaagacatgactatacttattatcgtaggaataatcgtactgttgggaatcatttttgcttccatgtacaactcattggtgagactgagaaataaccgtgaaaaagcttttgcagacatcgacgtgcagctgaaacagcgccacgaccttatcccgcaactggtggataccgtgaaaggatatgccgcacacgaaaaagataccctcgaacgggtgattcaggcacgtaacggtgcagtcagcgccaagacaatcgacgaaaagatagcagcagagaatcaattatcttccgctttatcgggattgaaaatcacgttggaggcttatcccgacctgaaagcaaaccagaatttcctgcaactgcaagaagaagtatccgatgtagagaataaattggctgctgtacgccgttactttaactcggctacgaaggaatataataatgcggttcagacattcccgtccaatatcatagcaggtatggcaggtttccgcagagaaatcatgttcgacctgggtaccaacgaacgtgcgaatctggaacaggcaccgaagatcagtttctaaaaacgagcacgtatgcagtacgtcggaatccaaacacagcagagccggaacaaccggcgctctgttcttctgttatttctatttccctgcctggtagcagcattgctttatctggcctgttatctattggtcgcctttgggcacggtgagagcatggaagtaagtatcctggaattggctaatcctcttttcatcaatgccctcccctatacgatgggtgtcgtattgatttggttcctgatagctttctgggcgaatacgagtatcatcaaagccgccacaggcgccaaacctctcgaccgcagagaaaacaaacgtgtctataatctggtcgagaacctctgcatggcaaacggaatgaaggctccgaaaatcaatatcatcgacgacgattcattgaacgcttttgccagcggtatcaacgaccgcacctatacggtcactctctcgaaagggattattcagaagttgaacgacgaagaactggaagcagtcatcgcccacgaactgactcacatccgcaacagggatgtgcgcctgctgatcgtctcgattgtatttgtcggaatcttctcgatgctgacgcaaatcactttctatactattacgcacacgcgcatacgtagcaacggaaaaaacggtggaggagctatcctcatcatactgattgctttagtaatagcggctgtcggttacttctttgccagtctgatgcgcttcgccatttcacggaagcgcgaatatatggcggatgccggttcggcggagatgacaaagaatccgttggcattggcaagtgccctgcgcaaaatttccgatgatccggatatagaagcggtaaaacgtagcgatgtagcgcaattattcattcagaatccgggcgaccagtcgaaaagtgccctcagcgggcttagcggactctttgccacgcatcctcctatcgagaaacgcatctccattctggaacagttctagggatttctgtttaattttcattaaagaaagcaggaggactccttatttttagtatatttgagtgttatacatatatacactaaactgtaactgatatgaaaacaagaaaacaaatccttatgctactgctggttatgctagcaggaatcccgactctttcggcacagaccaagaaggagaagaaggaacagaagaaagaagctgtcagacagctgatcgtatcagaagactacaagatagacgtcaacactgctatgcccatgcgcggacgttctatacctctgacttcacaatactcactgcaaatcagaaatgattcggtattctcttacctcccttattacggacgtgcttacagcgttccttatggcggaggaagcgggctgatattcaacgctcccctcaaagaatacacgatggatatggataagaagggaaacgccgttatcaaattctccgcacgaagtccggaagacttctttgagttcagggcgaaagtgttccccgacggcaccaccagcattgacgtcacgatgcagaaccgtcaggcaatcagctaccggggagaagtggatctggacaagaaataaaatcttcaagaatcgccgtcagtctcttcactaccttttaatataggaaggcaaatgtggtatttcacggcaaggatgcgtgtaacaaataccgccgatccgccaacgagctgacagacataagattccatccctgcggcatcgcacagccagtaagcgatgccgcctactacacacgccatcgcatagatttcttttcggaaaatcaaggggatctcattgataaagacatcacgaatcacacctcctgcggcacctgtgatactacccatgatgatggctacccaaaaaggatagcctaaagcgatacttttccccacaccgaccaccgtaaacaaagccagtccgatggtatcgaatataaaaaaggtattattcagacggatcagccagcgaccgaaacagatcacccagatcaaggcaagtcccgtacagatcaaatagatagggttcgtcatccatccgggtgtcacatccagcagtacatcacggatggtaccgccaccgatagcggtagcaagacctacgacataggctccgaaccagtcgaaacgctttgccgaagccagccggataccactaatagcaaaggcaaatgtgcctataaaatcaagaatttgaacgaatgtcggcatatatttgttattttgtatgcaaagtaacgaataaattccgtaagaaaatgtacttttgctacacgaattagatagaaacaatatgaaaataacaattgttgccggggcacgccccaatttcatgaaaatagcccctatcgcacgcgccatcgaagccgcaagagggctgggtaaaagcatctcctaccgtttggtgtacacaggcagacgggacgatacaagtctggatgcttccctgttttcggatctcgacatgaaagctcccgatgtctaccttggagtggaaagcagtaaccccaccagtctggcagccggaatcatgatcgccttcgaacaggagctgacggagaatccggcacacgtcgtcctggtagtggacgatctgacagcaaccatgagttgcgctatcgtagccaagaaacaaggaatcaaggtagcccatctggtagccggcacacgctcgttcgacatgaagatgccgaaggaagttaaccggatgattaccgacggagtatccgattatctgtttaccgccggcatggtggccaaccgaaatctgaatcaaacaggcacggaaagtgaaaacgtatattatgtcggcaacattttggtagataccgtccgcttcaaccggaaccggctgctcaaaccggtatggttctccgtactgggacttcaggagggcaactatctcctgcttaccctcaaccgacgtgtactgctcaacaacaaagagaacctgcggaagttgatgcaaacaatgatcgaaaaagctgccggtatgcctatcgtagcgcccatgcacacttacgtgcgcaatgcaatcaaaaacctcggcatagaagccccgaaccttcatatcatgcctccgcagaattatcttttcttcggatatctgatcaataaagccaaaggaatcatcacggactccggcaatgtagccgaagaagctacgttcctcggcatcccctgtatcacgctcaacacatatgccgaacatccggaaacgtggcgcgtgggaacgaatgaactggtcggcgaagatccggcggcactcgctcaggctatggatacgctgatgaaaggtgaatggaagaaaggcgagctccccgaacgctgggacggacgaacagccgaacgaatcgtacaaattttaacaagtaaataaccggagtggttgaccggactcaagaatcaatgagtccggcttaatagccagacagaagaagccggtcactgtcaggatcattaagtgtttcaaaaagtttcaagcgcttgaaacttttagtttcatgccgggaaacactttgtttcattgcttgaaacactttgtttcaaggcgagaaacttttggtttcaacggttgaaactgattttggaactacggaagacaatcggagcaagtcggttcgcatgatgtgacatacgttgaaaagggaaggacaaaaaggaccaaaacaatctgcctccttccattgttgaataatataagcttgtaaataacaaaaaacgatgggtaaaaaaagttatatactctattttactcagacttatttgttaactttgcagccctactacgaacgttatgatacaacgatataacaaaataataatactgctcttagtcgtatttgcagtttcaaatgcttttgcgcagcaaataaagggggttgtaactgattcagtcactcatgaaccactaatgtatatctctgtctattatcaagacaagagagaaatgggtactgtcaccaatattgacggagaatataagctcgacgcacggagaaacggaggaacgctcgttttctcttccatcggatatgtcaccaaaaccgtcaaagtaggctccggaaatcagactgtcaatgtcaaactctctccggacgatgtaatgctcaccgaagtagtcgtaaaaccacagaaagaaaaatactcccgcaagaataatccggcagtcgaattcatgaagaaagtgatcgaacacaaaaaagcacaagtgctcgaagtgaacgattactaccagtacgacaagtacgagaaaatgaaaatgtcgatcaacgacctgactccggagaaactggaaaagggtatctacaagaaatactcattcctcaaagaccaggtggaagtgtcggagacgaccaacaaactgattctccctatctccgtacaggaaacggcctcacagaccattttccggaaagaccccgaaagcaaaaagaccattatcaaaggaaagaattccaacggtatcgaagagtttttctccacaggagacatgctggggactgttctgaaggatgtttttgccgatatcaacatctatgatgatgacatccggctgctccaacagcgattcgtaagccctatcggcaacaatgccatctcattctataaatactacctgatggatacgctgatggtgaacaagcgcgaatgcgtacatctgacgttcgtaccgcaaaactcacaagatttcggatttacaggccatctttatgtgctgaaagattcgacctatgccgttcagaagtgtacgatgaacctgcctaaaaagagtggcgtcaactttgtcaaccgcatggacatcgtgcagcagtacgagcagcttcccaacgggaactgggtattggcggatgacgacatgacggtagacctttcatggagttccaacaaaacctcgggagggttacaggtagaacgaacgactaaatacagcaattataagtttgatccgatagaacagcggttgttccgtttgaaaggtcctgtgatcaaggaggccgacatgctttcgaagagtgacgaatactgggcgagtgtacgccaggtgccgttgaccagaaaggaaagcaatatggatgtattcgtcaaccgtctggaacagattccgggattcaaatatatcatcttcggtgcgaaagcattgatcgagaactttgtggaaacgggcagcaaagagcataagagcaaagtggatattggtcctatcaacaccatgatttcaagcaactacatcgacggaacccgtttccgcctgagcggtatgactactgctcactttgacaagcattggttcctgagcggatacggagcttatggtctaaaagacgaaaagtggaaatatagcggaacgctgacttattctttcaacaaacgagattatgtagtatgggagtttcccaaacattttatatctgcaacgtacagttatgatgtaatgtcgccgatggacaagtttctgtttacggacaaagacaacatcttcctttcgatgaagacgacaacggtagaccagatgtcatatatgcgtgatgctaccatcaactacgaactcgaaacgctgacgggattcggagtgaaagccatgctccgccatcgaaatgacgagcctaccggaaaactggaatatctgcggaatgacgccgcacaaacccgtgtgcatgacatcacgacttccgaagcgagtgtgacactgcgttatgctccgggagaatctttcgtcaactccaagcagcgccgtgttccggtgtcgctggacgctcctatcttcacgctgactcatgccatgggcttcaaaggcgtgctgggcggagaatacaacttcaaccgcacggaagcaagcatctggaaacgtttctggcttcctgcttcgtggggaaagatagactgtagcgtaaaagcaggggcagaatggaatgtcgtacctttcccgctattgattctgccggaagccaacttgtcatatatcactcaacgtgagacattttccctgatcaacaatatggaattcctgaacgaccggtatgcgtccatgtcactttcttatgacatgaacggaaagttgttcaaccgcatcccgctgatcaagaatctgaaatggagagaaatgttccgtatccgcgcattgtgggggacattgaccgacaaaaacaatccattcaagagcagcaaccccgacctcttccgtttcccgacacgcgacggtaaattcaccagtttcgtgatggacccgaaggtgccgtatatcgaaggaagtataggtatctacaacattttcaagttgctgcacgttgaatatgtacatcgtttcacctaccgtgacaatccgggtatcaacaagaacggtattcgtttcatggtattaatggtattctaagactatgcaacctttagcagaacggttacgaccaaagacattggatgattatatcggtcagaaacatttagttggaccgggggctatcctgcgtaagatgattgatgcgggacgtatttcttcgtttatcctctggggacctcccggagtgggaaaaaccacattggcacagattatcgccaataaactggaaactccgttttatacgctgagtgccgtgacttcaggcgtcaaagatgtgcgcgaagtgatagagcgtgccaagagcaaccgctttttctcgcaatccagtccgatcttgtttatcgatgaaatccatcgtttcagcaagtcgcaacaggattctttgttgggagctgtggaaaacggtacggtgacgctgataggcgcaacgaccgagaatccatcattcgaagtgatccgccctctcctctcccgttgccagctttatgtgctcaaatctttggaaaaggaagatttgctcgaacttctgcaacgtgccatcaccaccgacaccatactgaaagaacggaaaatcgaactcaaagaaacgacagccatgctgcgcttctccggcggagacgcccgtaaactgctcaatatacttgaacttgtagtggaatcggacacagaggaaacggttgtcattaccgatgacatggtgaccgaacgtctgcaacagaatccgttggcttacgacaaggacggggaaatgcattatgacatcatttccgcttttatcaagtctatccgtggcagtgatccagacggggctatttactggctcgcccgcatggtagaaggtggtgaagaccctgctttcatcgcacggagactcgttatctctgctgccgaagatataggtctggccaatccgaatgcattgctgctggcgaatgcctgctttgaaactctgatgaaaatcggttggcccgaagggcgtatccctttggcggaaacaactatctatctggcaacgagtcctaaaagcaattcggcatacagtgccattaacgatgcattagaactggtacgttccactggaaacttgcctgtgcctctgcacttgcgcaatgctcccaccaagctgatgaaacaactgggatatggacaggaatacaagtacgcccacagctacgaaggcaacttcgtgaagcaacaattcttgccggacgagctgaaagaaaaacgaatatggcaacctcagaacaatgccgccgaacagaagcatgcagaacggatgcaacagttatggggagaaaggttcaaataagtattaggtattaagtattaggtattagccgtagccgtgaaagaaaatttattaaaagagaagtctaccaaatttgcaattcgaataattaatctatataagtatttaagagattgcaagaaagaaacaattctatcaaaacagatattacgtagtggaacttctatcggtgctaatattagagaagctatttatgcagaatcacatcttgactttatacacaaatactctatttctcaaaaggaatgttctgaaacagaatattggctatatttacttcagcaaacagaatatataagcgatgaacaatatgaatctattaatactgactgtctggaaatacttaaattactgacagcaacaattgtaaaactaaagaacaatgggaacatcccataatacttaatacttataacttaatacttaaatataatgaaaacagtagttttagacggctttgccgccaaccccggtgatttatcatgggaaggtttgaaagctctcggagaatgtaccatttatgaccgtactgcccccgaagaagtattggaacgcgcagccggagctgaagtgattctgacgaataaagtaatcatcaacgccgatcacatgactgccttgcccgaactgaagtatatcggtgtgcttgctacgggatacaacgtagtggatacggcagtagccaaagaacgtggtattattgtaactaatatccctgcatatagcacagcttccgttgcacaaatggtatttgcgcacattcttaatatctgtcagcaggtacagcatcattcggaagaagtccacaaaggtcgttggaccaataacaaggatttctgtttttgggatactccgttgatagaattgcgggataagaaaatcggtcttgtcggattgggaaatacaggatatactactgctcgcgttgccatcggtttcggtatgcaggtatatgctttgacttcaaagtctcacttccagttgccaccggaaatcaagaagatggatttggatcagttgttcagcgaatgtgatattatcagtctgcactgcccgctcactccggaaactcacgaattggtgaacgcacgccgtcttgctctgatgaagccgaatgctattttaattaatacaggtcgtggcccattggttaacgaacaagatcttgcagatgcactgaacagtggcaagatttatgctgccggagtagatgtactttcttcggaacctcctcgtgccgacaatccgttgctgactgcaaagaactgctacattactccgcatatcgcgtgggcaagcacagaagctcgtgagcgtctgatgaatattgccattagcaatctacaggcttatatctccggaacaccggaaaatgtagtgaataagtaaaagactatatatttgaataatacggaaaaggctgtttcttttttattttgaaacagcctttatactctaccccatcttaccattccttaaaaggaaattaaatcttatactaataaacctcacgaatatgttcgaattaaagtttaacctgaaaggcacaattaatagaaaagagtttctgctatccatgattctgtcaattataaatttcattgtatgtctagcaatatccatgattgatctatttatacactttggaggcgattacaaaacgggaacaacaccttcattaagtttttggggaggaatcattctgtttataactacagttatgattctcataacattatggtattttcttgcacaatgtatgaaaagattgcgtgatatttcgttatccggtctgtggttattggtattaatcgttccaatagcgaatatcttcctgttagtatatttattatttgccaagagtactgacaatacccaaaaagatatctctgcttgaaacacgatagatgagttacataaaagaaaagctattacagaggatgttataattaaaagaactccccttatgtaagtcaactccatatcatagaaattgccttatataaggggaatttccggtaaatcccaataaaatattcaatcggttattccatttaggaaaagttatatttaataggaatgtcctccttcatccatctccttctctgtaatcttatggcggtcgatactacgccatgcatagaatatataagctatcacaaacggaacaagaatagagacataagccatagtcttcagcgtaaattcactcgaacagctgttagccaatgtcagcgaactttgcaagtccgtatatgaaggataataagcagtgttattatatccggctacgagtaacaaagccaagactgtcagcactgtacctatccctgcaaaccagattcctttgtcgaaagtctttttcagaactgtcttaccgattccaaaaagtaccaatactacacctatcaggaagatgatcagaactaccggcatttctataaagttgataaagtacttataaggctgcatataaacctccaatgtatccggattgacagcaaaaccgtcagaaaccaatgtacggattacaaataccaaaaagaatacaaggaagaaaatagtattattcaatactgcacgacgacatttatcggtcagttccttatccgctatactattaatgaaatagagcgaacccaacacacgcgccaaaaagaatacagccagtccgagaataacattccagatattagtcaacgcgtccagtccgtgccatccatttccccaatgactgataaccggcataatcgtatccgtcatattcgccttattgatatagaaatcagaaccggtgaagaaagtagcaactgctccacccagcaacagaggtcctacaaccccattaattaccaagaaagtctgataggtctttttacccagcaaattccctgccttgctctggaactcgtaactcacagcctgcaacacaaaactgaaaagaataatcatccaaagccagtaagccccaccgaaactggtactgtaaaacaacgggaacgaagcaaagaaagcacctccgaacgttaccagcgtagtaaacgtaaactcccacttacgtccagtagagttcaccatcatcttacgatgttcctccgtcttacccaaacagaacaataaagaatttcctccctgcacaaataataaaaatacaagtatggcccccagcaaggaaacgaccagccaccaatattgttgtagaaatatatacataatatgtaagtattaagttttaagtaataagtaacaggtaataagtaataggtaataagtaataaccatgctgataaatcagtcagcagctacgattattacttaatacctattacctattacttatctcttcttccggtcctttcttaatcgccttcaccataatccctatctccgcaatcagcattacggtaaacaagatcaggaagataaagaaagtagcctgaacggagcctacatccaatttagagatagccgccgatgtaggaagcatatcgcggatagcccaaggctgacgaccgcattcggcaaccacccatcctgcctgtccggcaatgtaagccaaaggaatggtcagcagagcgatccaatgcatccagcgcatcttactcaaatctttcttatatataaagaagagcacaactatgaagaaaaggataaaatatccgcccaggataaccattatacggaaagcgtagaagttcagaggaacattcggaaccagctgattcacatctttaatatatccgtatccgaagtatggcatattctcctgcaaaacctgataggcaacagcggcatcttcctcgtgcccggcgctcttcgctgcacgataagcagccagcgctccgatagcggtcttaccccgctctatcttttcggctgccgacaaagcagtcgtaccgtctttcagctgatagccgccttcgataatattggtaattccggggacatacccgtccacatcccgctcggcaaggaacgaaagcatactgggtatctcaatccggaacaggaaagggtctttcccatcattgtaagtcttcttttcggggttcagcattcctattcccaccagacctacattggttcctccttcataaagtccctctacagccgccagtttcatcggttgggtctgtgcaatctgatagccggaaccatcgcccgtccatacagccagcagtgaagagacaagcccgaagatagcaccgatctttatgcttgcaagcgcaaactcgcgattacgtttcttcagcagaaaccaacaactgattcctacaacgaacacgccaccaagtacccatccggacaataccgtatgaaagaacttgttgaccgctacaggcgaagttgccaccgcccagaaatcaaccatctcattacgcactgtatcgggattgaactccatacctaccggatgctgcatccatgcgtttgctacgagaatccaccaagcggagatcgtagcccccagaccagtcagccaggtagaagcaaggtggaagcgtttgctcaccttatcccatccgaagaacatgacagcgataaacgtggcttccataaagaacgccagaataccttcaatagcaagcggtgcaccgaaaatatcacctacaaaccaagaataattactccagttcgtaccaaactcaaactccaggatcaatcctgtcgctacaccaatggcgaagttgataccgaaaagtttcatccagaacttggctgtccgcttccaaaattcattgcctgttttataatacaacgtctccattattcccatcaccacagccagtccgagggtgagcggaacgaaaatccagtggtacatggctgtcatcgcaaattgggctctcgaccaatcgatcagcgaggtgtcaatactttcaatcataatcttatgtagtttaagagttaaaaatcagtggttttctccggaagtgcacgctgtatcagctcatttcccacatacgtacccttgtcggcatctgtaggatgatcgccgagaaagtcgggaaagaagaaaattttgaggatgaagaacataatgaataatttcactaagataataagccacaaagtacgacctaacgtcatactacggaaaccctccaaataaaagttccatattgcaagcagtgtattcttcataagctgaccttagaatttgtaatgagtacaaatatacaatttttataattaaaacaaacaagtaaggcaaaatgttgcatgatttgtatggtttttctcaaaaaacctgcctatcgacagaaaaaaaacatttaacggcgaaaaagcgccatctgtctatcgcttttgcagctaatataatatgtacgtaccttcgttccagtaaatcaatagacatataaaaatatgataaatgtaagaagattgacagtgatagcatttcttggagcgggtctgctgcccggtatatccgcccaggaatcttctgtgcagacagccgcccagagcgagatgaatctccccgcccaatgggatttacagtcgtgcatcgactatgcgttgcaacagaacattacgattcgcaaaaaccgggtgaatgcggaaagtacacagatcgatgtgaagacagccaaagctgccctgttccccagtctgtcgttctcaacgagccagaacatggtgaaccgtccgtatcaggaatcaagcagaacgatcagcggaagcgaggtgatcgagacaaccagcaagaccagttacaatggcaattatggtctgaatgcttcgtggaccatttataatggtagcaagcgactgaacaccatcaaacaggagaagctgaacaatcaggcagccaatctggatgtagaaacgtccgagaatagtattcaggaatctattgctcagatttacattcagattctctatgcagcggagtccgtcaaggttaatgaaaacacgctgcaagtttccattgcgcaacgcgaccgcggacaggaacttctgaatgccggaagcattgccaaaagtgatctggcacaactggaagctcaagtcagcaccgaccgttatcaattagtaacagcgcaagccactctgcaggactacaaattacaactgaaacaactgctcgaattggatggggagaatgaaatgaatgtctatctccccgccctgtccgacgaaaacgtactgttgccattgcccaccaagaaagatgtgtatatgagcgcgctcaccctccgtccggaaatcgaggcgagcaaactgagcgtagaggcttcggaactgggtatcgatatcgccaaagcgggatatctccccaccatcagtctgagtgcaggtatcggaacgaaccacaccagcggcagtgacttcaccttcggagaacaggtaaagaacggatggaacaactccatcggagtttctgtcagcgttcctatcttcaataaccgtcagaccaagagtgccgtgcagaaagcgaagttacagcgcgaaacaagtctgctgtcgctgctcgacgaacagaaaacactgtataagaccatcgaaggactttggctggatgcaaacagtgcgcagcaacgttatgcggcagcgaacgaaaagctgagaagtacacagatcagctacgacctgatcagcgaacagttcaatctgggcatgaagaatacagtagagttgctgacggaaaagaacaacttgctacaagcacagcaggagcagcttcaagccaaatacatggcgatactgaacactcagttgctgaagttctaccaaggagacaaactggcattataagccttcttccttactaaaagcggaatataaataagtaaaacagaatatagaatgaaaacgaaaaagattatcctgatcgctgtggcagttgccgtagtagtgggcggaggaatctggttctttacaggttctccggcaaagcacaaggtgatgtatgccagtgcgactgtcagtaaaggcgatatctccaattcggtgactgccaccggaacaatcgaaccggtgatagaagtagaagtcggtacgcaggtatccggtatcatcgacaaaatttatgtagattacaactcggtagtaaccaaaggacagctgattgccgagatggaccgtgtcactttacagagtgaactggcatcccagcaggcaacttacgatggtgccaaagccgaatttgaatatcagaagaagaactacgaacgtagcaagggattgcacgataagtcattgatcagcgataccgactacgagcaggctctctataattatcagaaggccaagagcgctttcgacagcagcaaggcatctctggcaaaagcagaacgtaacctgtcatatgctacgattacttctccgatagacggagttgtcatcagccgcgatgtagaagccggacagaccgtagcttccggattcgaaactcctaccctcttcaccattgcggccgacctgacacagatgcaggtagtagcagacgtggatgaagcagatataggcggtattgaagaaggacagcgcgccagctttactgtcgatgcttatccgaatgatgtgtttgacggagtcgtgacacagattcgtctgggagatgcaagcagtagcagcagcgccagttcaagtaccagcacggtagtcacttatgaagtagtgatctctgctccgaatccggacttgaagctgaaaccgcgtctgacagccaatgtgactatctttatccttgataagaaagatgtattgtctgtccccaacagagctttgcgtttcacccccgaagcaccgttgatcggtaagaatgatatcgtgaaagattgcgaaggcgaacataaggtatggacgcgcgaaggaaccacctttacggctcatccggtagaaatcggaatcagtaacggtatttccacagagatcatcagtggtgttgccgaaggaaccaaggtcatcacggaagccactatcggtgctatgccgggcgagagtatggatggagaaccgggtcagggaaacggagaaagaagcccgttcatgccaggacctccgggaaacaacaaaaagaaaagcaacaagtagccaagtatgaaaaaagtaattgaacttcaaaatatcaaacgagactttcaggtgggagaagaaaccgtccatgcgttacggggcgtttcgttcaccatcaacgaaggtgagtttgtgaccattatgggtacttccggttcgggaaagtccacactgctcaacacgttgggctgtctggacactcctaccagcggggagtatctgctcgatgacatctccgtgcgtaccatgagcaagcctcagcgtgccgtactgagaaaccggaaaatcggcttcgtcttccaaagctacaacttgctgcccaagacgacggctgtggaaaacgtagagttaccgctgatgtacaattcgtcagtgagtgcttctgaacgtcgccggcgtgccatcgaagcgttgcaggcagtaggcctgggcgaccggttggagcataagtccaaccagatgtccggaggacagatgcagcgcgtagccatcgcccgtgcactggtaaacaaccctgcggtcatccttgccgacgaagcaaccggaaatctcgacacacgtacgtcttttgatatacttgtcctgttccaaaagcttcatgcggaaggacgtaccattatattcgtaacgcacaatcccgaaatcgcgcaatacagcagccggaatatccgcctgcgcgacggtcatgtcattgaagatacagtcaacacgcatgtcctgtccgccgccgaagcactagccgcattgcccaaaagcgatgaggattgaagataagtaataggtaataagtattaggtatcaggtattaagtattaggtatcaaatattaagtattaagtaataagtaatagtagtttatgaatggaactaacttatttaaaatagctctccgggcattggcgaacaacaagctgcgtgctttcctcaccatgcttggtatcatcatcggtgtcgcttccgtcatcacgatgctcgctatcggtcagggatcgaagcgaagcatccagcaacagatatcggagatgggatcgaacatgatcatgatccatccgggagccgacagacgggggggggtccggcaagacccatcggctatgcagacgttgaagctgaccgactatgaggccttgcgcgatgagaccaatttcctgtccgccatcagtcctaatgtgtcttcgtcgggacagcttatcgcgggtaacaacaactacccgtcatccgtcagcggtgttgggctggagtatctcgacatccgtcagctgagtgtagaaagtggagatatgtttacggaagccgacatacaaagttcggctaaggtctgcgtgatcggtaaaacgattgtagacaacctctttccggacggaagcgatccgatagggaaaatcatccgcttcaacaagataccgttccgggtggtcggtgtgctcaaagccaaagggtacaactctatgggacaggatcaggacaatatcgtactggctccttacaccaccgtcatgaaacgattgcttgccgtcacctatcttcagggtgtctttgcttctgccctatcggaagacatgaccgagtatgctaccgatgaaatcacggaaatcctgcggcgcaaccataagttgaaagcttcggacgaagacgatttcaccatccgtacccaacaggagttgagtacgatgctaaactctaccaccgatctgatgaccaccctgctcgcctgtattgccggaatatctctggtagtgggcggtatcggtatcatgaatattatgtacgtgtccgtcaccgaacgtacccgtgaaatcggtctgcgtatgtccgtcggcgcacgtggcgttgatattctgagccagttcctcatcgaggctatcatgatcagtattacgggaggtcttatcggagtcatcataggctgcggagccagctggatcgtgaagagcgtggcacactggcctatcttcatccaaccttggagtgtcttcctttctttcgctgtctgcaccgtcaccggagtcttcttcggatggtatcctgcaaagaaagcagcagatttagacccgatagaggcaatcagatacgaataaaaaactatctttgtctttatgaaacaaagcctaacatccgcacgtcgtcccctggaagcactgatacacattatcggctgggggattatgttcggttttccgttcttctttgtagagcgcgaaaacggaaacatcaactggatggcatacttacgccattctgccgtaccgttgtctttcatgatcgcgttctacgtcaactacttcctgctggttccccgatatctttttcagagccagaccaagagatatattacttacaatattctcctgttatgtgtcatcggtctgatgctgcacctttggcggagtctgacattcgatccttcctttgttcccaagcctcaccggtcgggtggtcctccgggatggctgttctttgtcagagatatgctgagtctcgtcttcaccatcggactgagtgccgccatacgtatgagtgcccgatggacacaagcggaagctgcccgtaaggaagcggaacggaaccgttcggaagcggaactgaagaatctgcgcaatcaactgaacccacattttctgctcaatacgctgaacaatatctatgccttaattgcttttgatacagacaaggcgcaacaagctgtgcaggaactaagcaagctcctacgctatgtgttgtatgataatcagcagacctacgtcccgctaggcaaagagactgactttatccgcaactatatcgaactgatgcgcatccgcctgtcttccaatgtacagatgactacgcagattgatatactgccggacagtcggactcttatcgcaccgcttatctttatctcgctaattgagaatgccttcaagcacggtatatcgcctacggaacggagttttatccatatccatcttgcggaaaatgagacggaagtgatctgcgagataagcaacagcaaccacccgaagaacataatggacaagagtggttcggggataggactggaacaggtgaaccgacgactggagattctttatccaggccagtatacctggcagaaaggaatttcggaagacggcaaagagtacagatccaggctgagcatccgtgtgagagagagtattaataagtaataagtattaagtaataggtaataattgagagtatattcggtttaggtaattaaataaaatatagagaattatgatattacgttgtgccattgtagatgatgagccattggctctgggcctactggaaagttatgtgaataagactccgtttctgcaacttacaggaaaatattccagtgcagttcaggcaatgaaggagttgccgggcgaagaagtcgatcttcttttccttgacattcagatgccggaacttaacggactggagttctcacaaatggtagattcccgtacgcgtatcgtttttaccaccgcattcggtcaatacgctatcgacggttatcgtgtcaatgcactcgattatctgctgaaaccgatctcgtatgtcgatttcctgcaagcagccaataaagccctgcaatggttcgagctggtgcagaagccggaagagatagacagcatctttgtaaaaagcgactataagctggtacaggtagaactgaaaaagatcatgtacatcgaaggactgaaagattacatcaaaatatatacggaagatgatgccaaacccatcttgtcactcatgagcatgaaagccatggaagagcttttgccttccagccggttcatacgtgtacaccgttcattcatcgtccaaaaggacaaaatacgggtgatcgaccgtggacgtatcgtctttgacaaaacgtatatccccattagtgatagttacaagcaggtttttcaggcatttttggatgaaagaagctgatgattgtctaatttatcggcaaaaaagtgaattttgtcgattatagtttgtcagaaatcggttttatatgtaactttgcaacgaacagaaagggattgtgaaattccaagaatagaatagtttagttaagtctagtttagtttttgtgttgagtgcttcctcgtcggcggacgatctaggaagcactttttatttatctatttatagaacaagctggacgatagcactaaatcaaagaaaaataacataaagtttgattatacctaaagctcttttatattctattaaatcttaatgcatttctttttgcgagcaaagacttgactccgtttgtttatagggggatgctcaaacaagaacagctctccggacgttatactactgatatcaaccaaattataaacattaattgcagataatatgtgtttccacaactccatgtcagccaaagccatcaaagttgccgcccgttacggacgccaatcggatgtagtcgagatttaccaaagcattcttgacgaacagtatcatgtgaatgcgttcactttccccagatatcctatcattacttcttcggacgaagtacaggttttcaactggggactcatccctttctgggtaagaagcgaagaggatgcgacagaaataagaaagatgacactcaatgcccgtgcggataccattttcgagaaaccgtctttccgcgaaccgatcatgaagaaacggtgcatagtgcccagtaccggctattttgaatggaggcatgaaggagcaaacaagataccttattatatatatgtaaaagatgaacctatcttctcgatggccggcatctacgaccgttggctggacaaggatacgggagaggaacacgaaactttctccatcatcaccactgacaccaattcgctgaccgattacatcgataacaccaagcaccggatgcccgccatactcacccgagaggaagaagagaaatggctcaatccctcattgagcaaagccgaaatagcttctttactgaaacccttcgatacagagaagatggatgcatacgttatcagaaacgatttcttaaagaaatctcccaatgatccgacaatagtacaaaggacataggaaaaagaagtttatcctaaaaaagtgagaggtgtgagagaggaattgcaacttttatatttttatttcactgtttctactctctaattttcaactaaaaaaaatacgaatgttagaaatcctctctcactcctctcactttttcccctttatttcatgaaattcggaagaaagtacaaaaagaaacagagttcaaagagtaaaacgtggtgggaaatccggaaaacataaccatcttttccgaacttcccaccacgttttatctagttcgcaccgtccggtgatttactcacccaactcgcccagcaaatcatacgacggcacaaagaaaagcgtccccgttattgccgtactgaaatcgagcaagcggtcggtattgcccgccggactgccgataaacatattctccaacatccggcgagtcgtgctgaatgtactagcatacccaataaaatacgtaccatactcccccttcgaagtattggcaaacggcatattggcacgtacaatcttcagatcatcaccgatattggtcacagcattatgcgcattctccggcttctcttcgtccgacagctccacatcattgaacttatgacgtccgatcaccttttcctgctgttccaccggaagcgcattccacgcaaccatatcatgaatgtatttctgcacaaacacataactgcctcctgcaaaatccgcatcctcctcgcctatcaccgcaaaatgatagggattctcatcgacagcaggattctccgtaccgtccacaaagccgataatcgccttaccatccatatagcggaatccatgcgtctcatcaacagacaccacagcccctttaagcttctcatcaaggatagaagcaaactcgaaacacagccccatctgcttcgcccgaatatggaacaacaaatcaccgggagtagaaacagctgtatacttctccccttttatctcggagaaagtactcagctctttcggtttacccttatcggggaaaagccgcgtccacgcatcagccccgaatcccatcgtgcaactgaattgcatatcaggaaaacgattgcgcatactacggatcattgccgagaaattggcacatacatcctttactttatcaaccgtatcgggggaatctgtcaggttatagactataaatattacattctctccctgttttccggccacatcctgtgggatatgaccgccgaacgaattttgaaatggattcatattcttttaattttagttttttagtttcgcccataagatatatccggtgataaaaccgaatcaaaaccgaatggctacataggcaagaagctcccggcttcgaccccgtgagcttctctcttctccaatgttactctctcttcttatatataatatactttgtctttatattgtctctctcttttcagtcattccgcacatacatcgcggctccggcatccataaagagttcgacattctccgcatgatgcgctatataagccgccggtcccgtatctcccgagtggcagatttcttccaccacttccgccttcgcctttccggtaatcagaaaaataacaaggcgggcagtcagaatcgggaatccggtcattgcaatgcgtttctgtccgttacggggatgagtgctggtcacataaatctggtcggaagagagcaaagcctcctgtccggggaagatagaggaagtatgtccgtcatctcccgctcccaacagcacaatgtcaaattcgggccagccattcttcttgggtacctgcctgctgacaagttcggaatagcgggctgcttcttttgccggtttctcttcaccgcgaatgcggtatacattttcgtaaggaatgggcactatccccaaaagcagggaacgcatcattccataattactatcagaatcttcgggaggaacgcaacgttcgtctacccaataaagtttcatacgcttccaaggagtaatatcagcgtattcatttgcccataaatcaaacatcaaagcgggagtgctgccaccactcactgctatgttgaacgttttgtccggttcagcattcatgatatccaccaagtggaatatcaacgaacgggctgtctccatagacgacgggaaaacagatagtttcatagttcgcaatattggtctgtatttgttaagttcttacacgggttggtccagtctgccccatgctcgtgcatcatagcttcactttcgagaggtccccacgtacctgccggatagccgtacaaaggtgcgtccggattatctttccaataacgtaagaccggatcaaagaaattccaggaagcctctacagcgtcacttcgagtaaataaggtcggatctccctgaatgcagtcgtcaatcagacgggcataagcgtcaccgctcggcacgccgcccaactgtgcgtaactgaaatccatcgtcacctgacggacttcgaaacctgcacccggaaccttcattccgatcttcagcacaataccctcgttgggttgcaaacgaaggatcaacttattagccctcggacagttaccgccggaacagcggaacatctgatggggcgtctcgcggaagtgaacgacaatctccgtcactttcgtcggcatctgcttaccggtacggatgtagaacggtaccccgctccaacgccagttactgatgcccaacttcatcgcaatataagtctccgtacgcgagtcgggagccactcccttttcctcacgataccccttcttattgcccgaagccgtatattgtccgcgaacgatatgttcgttcaagtccgtctccgtaagcggagtcagtgactcataaaccttcactacctcattccggaaattatccgcattgaataccgccggtggctccatagccgtaagagctacgagctgaatcaggtgattctgcaccatatcccgcaaagcccccgccgtctcgtaaaaacctccgcgctgctcaatgcccagattctctacagcagtaatctccacataatctatataattacgattccataacggctcaaaaataccattggcgaaacggaaagcaagcacattctgcgccgtctccttgcccaaaaaatgatcgatacgataaatctgatgctcatcaaacacagaagagtaaatcttatttaactcaagcgccgactccagatcatacccgaacggcttctcaacaataatacgagaatgaggagtattcagcccggcagccttcaaatgcaaaggcaccaccccatacagcgaaggcggagtagccagatagaacaacaaattatccggatcgacctccttcgtaagctctaccaaacgctcccgcaactgcgaatatccctccactttcgcagggtccatcggcaaataatacaaatgagaaacaaaagaagacatcagctccaaattctgctcttcagccttcacaaactgctgcaactccccaagtatatatgaacggtaatcttcatcagaatagacagtacgcccaattcccagaacagtaaaactccccgtcagccgtttatcccgatacagagagtacaatgcgggcatcaacttacgtttagtcaagtcgcccgaagcaccaaaaataatcattgcaaatttatccatcgtcgtatttttaactttttaccttttatctatccatcaccgcacctaaaccgggcagcctcaaccaaccgacaaaccgaccaatctccgccaatcgccctaacgcataatcacccacacacccactactacccccatctacaactttccatccgaacggtctcccggcctcaccgaaggagcgtcaagcggaggctgtatctccggcgtgaagaagggcaggctgtttgagcggagcgagttcctgccctttagccggagatgcggccggagtagctccgtaggtgcagccttgattttttcttttggtacctttcttttgcatcaaggcaaaagaaaagtactcatacattataagtccccgacttcgtctcccctccgtgccccgtccaattctcatgaaagaactgtccgcgcaactcatccttcctctcaaacgtatgcgcaccgaaataatcacgttgcgcctgcaccagattggcaggtaaattgtcagaagtcagcgaataaaaataattcaaagccgaagagaaagccggaacaggcaattcctccttcatcgcctccgccaccagattcttccatccggggagcaaagacttgatctcctcacggaagtaaggagccagcaacaaatgcttcggcttatccgccgcctcaaaagcagcagctatatcattcaggaaaatactacgaataatacatcccccacgccacatacgagcaatggaagccaaatccagattccatccgaaagaatcagaagcccgctgcaacacagcaaagccctgcgcatacgacaccagcttggaagcgtaaagcgcagaaaatatctccttcaccaattccgccttattatatataggtaatgtatgcttgcacaagaactgcttggaagccagatgacgcaactccttctgagccgacagactgcgttcgaacaccgccgtggcaatcaagcccaacggcatccccaactccatcgcattgatgacagaccactttcccgtccccttctgtccggcagcatcgagaatcttatcgatcagatacccaccggatttatccttgtgacgcaaaatattagaagtaatctcaatcagataactgcgcaacttcccttcattccaacgggcaaaaacgtccgccatctcctcattcgtcagatcaatgagattcttcatcacccagtaagcctcggcaatcaactgcatatcaccgtattcgataccgttgtgaatcatcttcacaaaatgtcccgatccggcagggcctacccactggcaacaaggagttccgtccggtgctttcgccgcaatgctctgcaagacaggcttcacttccggccatgctttctccgatcctccgggcatgatggaagcaccgttcaacgcaccttcttcaccgcccgacactccgcttcctacaaacaagaaacctttcgattctgctaattttacacggcgattggtatcttcgtaattagaattaccaccgtcaatcaaaatatctccgggagaaagcaaagggaaaagctgatccatcagttcgtctaccggactgccggcacgtaccatcatcataatcttgcgaggggtggcgattgattccacaaaagcctttatatctgtaaaaccttcaatgtttttacctttagcacgaccattcatgaagcggtctactactccttcttccactccggggacggtacgattgtaaacagagacgtgccagcccttgctttccatattcaaagcaaggttctcacccatcactgccagaccgatcaacccgatatctgttttattctgatttgccatatcttatatattttaaaatattgtttatgtaagaaacacttgaaaagcacatttgttcgctagttttagattaaaatactatttttgtagtcaacaaataactatcagaatgaagaaaatcaagatcggcctgctgccacgcatcattattgctatcatcttgggtattgccattggtactatttttccggctccgctggtacgaatattcgttacgttcaacggaattttcagtgaatttcttaacttctccatcccgctcattatcgtcggactggtcaccgtagccattgccgacatcggcaaaggtgcgggaaagatgctgcttgtcaccgccctcatcgcttacggtgcgacgctcttctccggcttcctgtcctacttcaccggtgtcaccgtgttcccctcgctcatcgaagtgggcgcaccgctcgaagaagtcagcgaagcgcacggcattctcccctacttctccgtatccatccctccgctgatgaatgtcatgacggcattgatccttgccttcacactgggattgggactggcggcactgcacagcgatgctttgaagagtgtagcacgggattttcaggaaatcatcgtgcgcatgatcagcgcggtcatcctgcctttgctgccgctttacatcttcggcattttcctgaatatgactcattccggacaagtatatgccattctgatggtttttatcaaaatcatcggagttatctttctgttacatatcttcctgctcgtctttcagtattccattgcggcactcttcgtccgtaagaatccgttccggttgttgggcaggatgatgccggcctatttcaccgcattgggcacgcaatcgtccgccgccaccattccggtgacgctggagcagacaaagaagaacggagtatccgccgacattgcaggattcgtgattccgctctgcgccaccattcacctgtccggcagcacgctgaaaatcgtggcctgcgcactggcactgatgatgatgcagggaatgccgttcgacttcccgctgtttgccggattcatctttatgctgggcatcacgatggtagccgcaccgggcgttccgggaggagccatcatggcggcactcggtatcctgcaatcgatgctcggcttcgacgagtcggcacaggcgctgatgatcgcactctacatcgccatggacagtttcgggactgcctgcaacgtgacgggcgacggagccatcgcactgatcatagacaaagtaatgggaaaaggaacgggaaaataaaactgacttggtttgcatatacagcataaaataacgaaatttgtcccccgtattttcaaataaaaaataaaggaatatgaaaacagcccttatatcaggcatcaccggacaggatggttcttatcttgccgaatttctcttgcaaaaaggttacgaagtacacggtatcctccgtcgttcttcctcattcaataccggacgtatcgaacatttgtattttgacgaatgggtacgcgacatgaaacaaaaacgtaccatcaacctgcactacggcgatatgacggactccagctcactgatccgcatcatacagcaggtgcaaccggatgaaatctacaatctggcagcacagagtcatgtgaaggtatcgttcgacgtgcccgaatatactgccgaagcggacgctatcggcacactgcgtatgctcgaagccgtacgcatcctgggactggaaaagaaaacaaggatatatcaggcttccacctccgagcttttcggcaaggtgcaggaagttccgcagaaggagacgactccgttctatccccgctctccctacggagtggcaaagcagtacggcttctggatcaccaaaaactaccgcgaaagctatggcatgtttgccgttaacggcatcttgttcaatcacgaaagtgaacgtcgtggcgaaacattcgttacccgcaagatttctctcgctgccgcacgtatcgcgcaaggcgagcaggacaagctgtatttaggtaatctggatgcccgccgtgactgggggtatgcgaaagattacgtggaatgtatgtggctgattctccagcatgacgttccggaagattttgtaatcgccaccggagagatgcacaccgtacgcgaatttgccgcactggcattcaaggaggcaggcatcgaacttcgttgggaaggcgaaggcgtggacgaaaagggtatcgacgtggctaccggaaaagtattggtagaggttgatcccaaatatttccgtccggcagaagtggaacaactgttaggagaccctaccaaagccaggacattgttgggatggaacccaaggaagacatcgttcggagaactggtaagcatcatggtgcgccatgacatggagaaagtaaaaagaatgatcgctaccaagcactaacagacctcaaaccgaacgcggattacgccgattaaacgatcttctttttttacagtagatgcgcataaccggagtaatccgtgttcatatatgatacttaatcatggaaaagaatgcaaaaatctatgtagcagggcatcacggtttggtgggttctgctatctggaagaatttacaggataagggatataccaatctgatcgggcgtacgcatcaagaactggatttgctcgacggtgtagctgtccgccgttttttcgacgaagagcaaccggagtatgtgtttctggctgctgcattcgtaggcggcatcatggcaaacagtatttatcgtgccgacttcatttataagaacctgcaaatacagcagaacgtcatcggtgaaagtttccgtcataacgtccggaaactgctgtttctgggcagcacctgcatctatccgcgtgacgccgaacagccgatgaaagaagaagtcctgctgacttcaccactggaatacacaaatgagccatacgccatcgccaagatcgccggactgaaaatgtgcgagagcttcaacctgcaatacggcacgaattacatcgccgtgatgccgaccaacttatacggtccgaatgataattttgacttggaacgcagtcatgtcctgcctgccatgatccgtaagattcatcttgcgcactgtctgaaggaaggagactgggaagctgtccgcaaggacatgaatcaacgtcccgtagaaggtgtcaatggcgacagccccaaggcggacattctgaatatcctccgcaaatacggtatcagcgaaacggaagtgactctgtggggcacgggaactcccctgcgcgaatttctctggagcgaagaaatggccgacgccagtgtattcgtaatggaacacgtggacttcaaagatacctacaaagaaggtgacaaggatatccgcaactgccatatcaacatcggaacgggaaaggaaatcaccatccgccaactcgccgaacgaattgtagaaacggtaggctatcaaggcaaactaaccttcgacagcagcaaaccggacggcactatgcgcaaactgaccgatccgtccaaactacactctttgggatggcatcacaaaatagaaattgaggaaggagtacggagaatgtacgaatggtacttgaaataaattcaaaaagaactatccgcattggggctgaattagaaagaaacagactgaaaacaaccggtttttcggattaatccatgttaatgactgcgacatgcattgtggactgtcttaacaagcattgttaatgacattaccatgcattcttatcgaccctaacaagcattgataacttccctttcttatagagagaacagtaatgtcatctgtaaggaacaatcgtgccacaggccggaaacacttgtgccaaaggcgtggcacaactcctttccctatacttcccaacacttttcccatacttccacatcttagtcccttattaccccaagactccccatttccaaaaattcttcattcttaattcttcattcttaatttaattactatatttgcacaatttaataccaaatgtgcaaaaacaatggaaaagagttttatagcttacattgaaaatagtatcaagaacaattgggacttagacgccctgacagattataagggagccacccttcagtataaagacgttgctcgaaaaatcgaaaaactccatatcatctttgaagaaagcggaatccgcaagggagacaaaatcgccgtttgcggccgaaacagttcccattggggagtcactttcctcgccacactgacgtatggagcagtcatcgtccccatccttcacgagttcaaggcggacaatgtgcacaacatcgtcaaccactccgaagccaaattactatttgtaggagacatggtgtgggaaaacctcaacgaatcggcaatgcccctgctggaaggtattctgatgatgaacgacttcaccttactggtatcacgcagcgaacgactgacgcacgcacgtgaacatctgaacgaaatgttcggcaagaaatacccgaagaacttccgcaaagaacacatcgaataccataaggatgaacccgaagaactggcagtaatcaactacacgtccggcacaacgagctactcaaaaggagtcatgctcccctaccgtagcctctggtcgaacaccaagttcgcgtatgaagtgctcgaactgaaagccggagacaagatcgtctccatgcttcctatggcacatatgtacggactggccttcgagttcctctatgagttctccgtcggctgccacatctacttcctcacccgtatgccgagtccgaaaattatcttccaggcattcgaagaagtaaaaccgaatctcatcgttgccgttccactcatcatcgaaaagattatcaagaagagcgtactcccgaaactggaaacgccgaccatgaaaatcttactcaaagtacccatcatcaacgacaagataaaagcaaccatacgcgaagaaatgatcaaagcgttcggtggaaatttcagagaaatcatcgtaggtggagcagccttcaatcaggaagtagaacaattccttaaaatgatagacttcccttatacggtaggatacggcatgacagaatgcggtccgatcatctgctacgaagactggacaagattcaaactaggctcgtgcggaaaagccgcgccgcgtatggacgtacgggtactgtcttccgatccggagaatatcgttggcgaaatcgtctgcaaaggccctaacgtaatgctgggatattacaagaacagcgaagcgacagaagcagtgatcgacaaagacggctggctgcacacaggcgacctcgccttgatggacgccgaaggcaatatcaccatcaagggacgcagcaagaacctgttgctcagcgccagcggacagaacatctatccggaagaaatcgaagacaagctgaacaacctgccatacgtatcggaaagcatcatcgtacagcagaacgagaaactcgtcggactggtttatccggactttgacgaagcattcgcccacggcctgaagaatgaggatatcgaacgggtaatggaagaaaaccgcgtagcactgaacgccatgttaccggcatacagccaaatactaaaaatgaagatatatcccgaagaatttgaaaagaccccgaaaaagagcatcaaacgctatctgtatcaggaagcgaaaggataaaggaagtgaaggattaagggaatactctgtgaacctaaactgaaaaaaagagttataataaagatgaagataataaagacaatattcacggcagctgttctgatggctgccgtttgtttgccggcacagaacaagagtgcgggcatcaacctttccttctggaaagacatctgcacacagccgtatgacagcactcagacgacttatgtaaacctcggtctgctgtctacgctgaaccgtctcaacggcgttggcatcaacgcgctgggaagcgtcattcatggagatatgaacggagtacagatcacaggattagccaatcttgccggtggtacgatgcggggtgttcagatagcgggtgtcagcaatatcagcggaaacaacaccgtagggctttccgccgccggactggtgaatatcacaggcgacggctcaaagggggtcattatttcgggacttaccggcatcggtggggacaacaactcgggagtaatgataagcggtctgatgaatgtgacgggaaacatggcttcgggatttcagttttccggcgtgtcaaatatcacgggacagagtttcaacggtatgatgacttccggactcttgaatgtggtaggcgaaaacatgaacggtctgcagattgccggtatcgccaatatcaccgcaaaagacctgaatggcgcacagatcgggttatgcaactatgcgacgaaggctcatggctttcagatcggtctggtcaattactacagggaagatatgaaaggattacaactcggcctcgtgaacgcgaaccccgatacaagaatacaaatgatggtatatggcggtaacgtcacgcccgccaacataggagtgcgtttcaagaaccaactgttttatacgatcttgggagtaggtgcattcgatcagaatctgaacgataagttttctatcagcacgtcttaccgtgccggactggcagtgcctgtttacaaaggtttgtctattagcggtgacctcggattccagcatatagaaacgtgctccaacaagggtgaagtgattccccgacgcctttatggattgcaggcacgggcgaatctggaatatcagatcagcaagaaattcggcatctttgccaccggcggttacggactgacacggtattacaacaaatccggtaatttcgataaaggagcgatcatagaagcgggcattgtcctcttctaaggctgattaataagtaataggtaataagtattaagtaataagtattaggtattaaccgtagctatcatttagaggtatatctatctgtcattcaaagttttcatcactttatcaaagtgaaacaattcgataatgacgagcataagtatctgtcatcctgagcttgtcgaaggatctcctcttttgtagtcacaaagaagagattcttcctccttacagtcgtctgaatgacagacagatgcgtctctaaatggcagctacggttaatacctaatacttattacctaatacttatttatactttctctttaatcaacccgatgcgataagccacaagcaacttcttcaaatcctgaatctgcgtcacaagttccttccctttatcggtgtctttcaccatcatccgttgcgaattgaactccagtacaaagttggttgacttgatatccaacccttcttcaatggctttctgcctagactggaacggctcatgctgcaccaactgcatcccgtgagaatggtagacaagcgtatagcccgcaattcccgtctccggctgataggctttggagaatcctccgtcaataacgaacagtttgccatttgccttcatcggctgttcaccttgaattgtctttacaggcacatgaccattgatgatatgagaatgaggtcccaatgccccaaactcatctaatatctgatcgcagatatcttcgcgattgcgaagcgtgtagtaatatcccttcttttccttttgtatctccttgtcttccaagaaatagcgttcgaaagtcgccatcttatctttatcaaacagaggagcttccggaccacaccacatataccagatatagtccatcgcaaattctttatcatcctctccttcttcatcaaagtatgcagtacgaatcagctgatcggccttatcgagcaacttgcgtccccaatactccttgccacgtatcttgacatgcttgaaactgccatcctcattcaaaggtaccgaagcatgataaagaagattggaattggaaaccaaatacattccgccatacgtaaacaggcaacgcatgtgcttcttcaacttctcgctattcataaacgaatagtgaatcttttccacaagttcccgttcttcgtcggtcagtcgataaggatcggcaggatctacggtcgggaagtttgtgtcacgcagggcatattctttgccttcgtacacaaagactccacgctcaaaatcgatcttctccaacagcttccggttactcatcccgaactccggacgacggtctattatttcagcttccagcttaaactggatgatcgtaatcgccttgtgcatctgggtgatcagacgcaaagtcttctcattgtaattggtgtcggcaaaattcatcttcggcataaagatggtacacggatcatcggcataagtatccatggcaaaagttgccagaggaagcagattgattccataaccgtcttcaagagtacccagattgccgtagcgcatggacatacggatcacgttggctatgcaactgtcattgccggaagcggctcccatccacaggatatcgtggttgccccattgaatgtcgaagttgtggtaattgcacaaagtatccatgatgatgtgcgctccgggaccacggtcgtatatatcacccacaatatgaagagaatcaatagtcagacgctgaatcagattacacatggctataataaagtcatccgcccgcttggtagagattatggtgctgatgatgacattgatatatgcgtgcttattcggctcgacagacgtttcgtgcagtaattcctgaatgatgtaagagaactctgcgggcaaggattttcgaactttggaacgggtatatttggaagatacattctgacaaaccttcaccaactggttcagagtgatcagataccagtcgtccagatccttctcgcgggcttttaccagctgaattttctcttccggataatagatcaacgtgcagagttctttcttctccgcttcgcgcagggtattgccgaaaatctcgttcactttgcgttttaccgcacccgaagcattctttaacacatgttggaaggcttcgtattcaccgtgtatgtctgtcaagaaatgctccgttcctttaggcagattcaggatagcctccagattaataatttccgtacttgcatcggcaatagtaggaaaactccgggaaagcaactgcaagtagcggagatcgccaactatgctttcaggagttatattactttgagcagtcattatatgtactattttactatttacaatatgctatttatcgacttatcgtttatcgctataaatataacgatttatcatctacttattacaaattccagcctttaatgttcatcgtcagcccaataaaaacatcaacagcacctgcgcaatgatcacacgcagaaacatacacaacggatatactgtagcataagcgacggaaggattgtcacccggtatcgtatcgttggcataattcagcgccatcggattcgccatactgccgcacaacataccggatacactgccgaagtctatcttcataatcttgaaagcgacaaagccgaccaggaccgtcgggataattgtcagaccggctcccaaagctatccaaagcaatccttccggacggaagacagtatcgaagaaatgagcaccggcatccagaccaagacaggctagatacatggaaagccccaacgcgcgcagcatcagattggcgctgcgggtagtgtaagtgatcatgtgtatccgtgggccgaaagttcccagcaggatacccacgataatcggtccgcctgccagccccagcttcacgggagtactgattcccggtatggagaacgggatcgctcccaatgccaatcccaatacgatgcctataaatatgacaacaagattaggttctttcagacttttcactgcatttcccaatactttttctacattctgaatggctgctgcttcacctactactgtcaggcggtcgcccagctggagaatcagttccggagtggcaagtagttgcacacccgaacggtacacacggctgatattgattccataatggtttcttagtctcaatgagccaagtttctttccattcagttcggggcgggttacgacgatacgctgcgagatcaattcgctgtcaattgcattccagtctatatcttccttgttccagtccgtattttcttcctgttcaccgaaaagtactgtcagagccaggacattcttttccgctgtgatcaccaacaggcggtcgccttccttcaataccttgtcggaggtaggaatactgacatgaccgtcacgccacaaacgggaaatcacaaatttcggataactcatctgagctatatccttgatacttttattaaaaatagcggggttatgtacttgaaacgctgcgataaaggttttgttggcatcatccttttctttaatctccaagtcttctttatgaaccaagaatttacgaatcagcagtacggcaagaatcacaccgatcactcccatcggataggctaccgcacaccccaaagccggagtactgctctctatgcccatctgtttaagtgtctgctgcgcagctcccaaggcaggagtattagtcgtggctccgcaaaggatacccaccatatcaggaagagacacacctgtcgcataactggcaacaacagtcagcaaagtacccaacagaactacggccaacgccaacatattcagcgtcacccctcctttccggaaagaactgaagaaaccgggccctacctgaagccccagtgaatatacgaaaataaccagtccgaaactttctgcataattcagcatctgtggatcaaccgaaagcccgaagtgtccggcaaggatacctgcaaaaaaaacaaaagtgactcccagagatactccccagaaatgcactcttcccagccccagcccaatcgcagaaatcagtgaaagcaccacaactgcctgtaaggcagaatgttcgagaaacagattatataaccactccatgaattaaacatactaatagggcgcaaagataaaaactatttagtcccattcaaaacttttaagctttcatttcgcgccctatctcttctctaaattcttaatatcctgaaatcttatatgttatcctttaaattatctgtttgttatccgcaatctttttacctgtcacctccacctatcgctttttaccttttcaacctattccatgtggtatctttctacctgtcgttatccgaaatctctctacctgtcatcttttgtgtaatcatcattttcttttcatttgccggcactttccatctgccggctattatctcacctacctgtatattctacgaaattattccgaccatccagataaccgctcaatcgatttcctccgatgtatacatcatccaggtaagatacatcattgcgaccgtaatccatgcgaatggaagtctgtgcataattctcccagttccaacggaaataatattcgaatgtctccacatgtccattaggatattctacccgaataaaatcaacgcctgtccgatccaaataaaagtcgagttcctgacggcaacggttaccgtccacatcccgataaaaactcacccatgtacggctacataaatcagaagaacgattatagtaaccaccaccgatattatcatcatcataaaaactatcgatttctacttcacaagaagtcagactcaacgttaacacagccattaaagccagtcctaagtatctaaatgcgttcgttttcatattcctttatttttaatggttcctttattaatcctatcatttatctttcgatattacaaaagtagggaatgaattctccttatgaaattgaaaattcctacttgtttaggggaattcacctaatggaagaggtaaattcccccaacgtactggataccttacagattcctaaatagctaagaagacacgcttccgccctccagaaccttaataaacattgaatcaaacattcaattatttaatcaatgttataaatcaagccatttagcccgatttatttgcagatatcacaaaactccgtatatttgcaatgtgtttttcatagtattagatttaaggttaacaaaaagattggctgtctgggatagatagcctttttttatgctcttttttttaataaacttctcaagaagccatgaagacaaacgtaaaatggcaaatactgatgtgaaaaatctgatgacaccacaggcttctataataattaataaggtaatcgttttctcccatgaatagtgagaaaaaatattctcaaaaaaaataatccgtttaacatttgaaacatagcaagttatctctttcatcaaaaaacaagtaaaaaaaatcttgctaaaagatttgcgtagtccaaaagttccccctatatttgcaccgcatttgagagagaatgcgggttcaaggaagtttgggtgagtggctgaaaccaccagtttgctaaactgacgtacgggtaaccgtaccgggggttcgaatcccccagcttccgcaagattctctaaataaaaagagctaagttttatagacttggctctttttaaatctatcaaaagccggtgggttcgtctaacggttaggacacatgcctctcacgcatgtaatacgagttcgattctcgtacccactactctattttagttagcctcttacattgaagtaagaggctttttttattatgttcatatctcaagaaatggaatataacgtaaaagaattgaaaaaggtattgattgaacaatgcaaagaagaaggtatttattacgcattgatagcaatcaacaaacagacgaaagagatcgttttgccacaaagccttgataacgctttaaataatccggattactgcgtctttaaatgcaggaaagtgaaggatgaatataaagtagaagaggtaaaataagcataattaaaaaaagaaggatatgcttattgatattgtattaagatgttaaaagatttaataattatttgagcattcaaagttttttctgtaaaagaatgttatatccatgtaaaacgattgtgtttcacatggatacccgccaacaaatgaagaaaaacgctgcttacttacatttcttcactctgctcgtacaattcaaagtaagactctttatcaatccgcagtcggactctgttttcccgcttctgaccggccaggttgataaataaattgaagtataattgactaaaagagaggtcggaacgatcataagtgatatcgaatgtacatgttcttcggaatgaatcgaaagttcccagcttcatacctcccttacacataaagacttcggggaaattcgcaggcggataaggctgaaacaagctggccagctgcgcatacacataatcgatcatccattcatcaccggatacaagcaattctcctttcagacgaagtttgactgcatatttagccgtgacgtcctgagaagtataaatggggacctgactctctgatggataattaccatccttatagccaaggctcatggtcagttttgatttacccacgccgttgaaatccgccacattcagatctttctgttgatttttcaagtcaatcataaatgtcagtttacccaaagtcgggtcattcggatattgagctatcgtatccagcacataatcttcttcattaaaactccgcgctaccaatacatccccctctccgacttccaacgccggacctcctctttcaatatccacatcgcctacagggtaatatattgcatcattatctctgacacaacctgtcagacaaagcagtaaagctgctattcctattatcttattcattatcatattacatccttattttggagacaaagatacatcttttttgaatcaacttgatttatatcaaccgtttttagtacttttgcacataacaagactataatgacatggatacactactaagagaaactgtaaatgccgtcgtaaattcccgctttcccgaaatgagtatagagggacgccgacagatagaaagcatcctgatacgtgaggaatatcctaaaggagtgatcgcacttaatgaaggagaagtagcccatgaattagtttttgtcgggaaagggatgctccggcaatattattataaaaacgggaaagacgttaccgaacacttctcatacgaaggctgtatcctgatgtgtatcgaaagcctgctgaaacaagtccctacccgattgatcatagagacactggagcctgctgtcatctatctgttcccttatgacaaaatgatgcagctgacaaagcaaaactgggaaatcaatatgttctatcggaagatactggaatattctctgattgtatcgcaaaccaaagccgattcctggcgtttcgaatccgcccgcgagcgttataatctattgctcgaaactcatccggaaatcatcaaacgggcacctttggcacacatcgcttcatacctgctgatgacaccggaaacattgagccgagtacgttcaggtgttctgtagttttgtaattttggggagctatctgcttttccggtattctttgggagacataccggtataatgcttaaagtacttaccgaagaacgactggttggcaaagtttaaacggtcggctatctcctgtatgttcatgctcgaagaattcaagagtgccttcgcttccaagatcactaattcgtcaatccactcccctaccgtcttcccgctgacttccttgacaactccggacagatgtttcggcgtcagacacaactgatccgcataaaacttcacgctgcgttccgactgataagactgaaccaaagattcatagaagcgctcaaatatatattctttacgacttttacttttgacaacggcagaagcatccggagcataactgttgaaaatattgcaaagctcaaagaagaagccctgcatcaatcccattactacctccctacggtacctatcgtctttatttttcaatctctttctgatgaaagcatgatactccttaatcatctcctgctcgtgcagattgagatcaaaacaagggtaatctttcagaaagaaaaagaatgaaagcacattaccaactttgggcaatgattccaacagactttttgatacagcaaagaaaatccctctgaaattggaactgaactgacgatgttcgattatctgattgggcaacgcaataaccattctgcccggaatcagttcaaactcacgcagactgatattaaaacgagtagagccttccagacaaagtccgatgctcaccacttccagtttactggggccattataaagggaaataacgctctccgtgtcgaagagcgctatatcattgccgaccacatcaatactacccggatctatatgtttagaatgaactaccgaagaaatacctatcttaggaacaacttgcatatccatacactctcttttttggttgcgacaaagataccagtaataatgagatgttcaacctaaggcgagagattatctgtcaaaaagaacacttttgcctacttattgactatctccgaataaaaacttataatcacgttcagcagccggaacagtccacttttcaggaacgaatttccattggttcaatgccttcggggccatagtacctttcttttctatataattcatcagatagaaacgaagatccttatccgtagagaagatgatacgctctttcaatttctcctgcgggatgcctgatcctttcgtcagcagttctccaccgccattcccccggtaagagttcaaagccaccttataaatcttatccatgaggaaaggactgccgtctgccatgctgataatcgtaatcttctccccttgcggcttggtgacgtctacggtataaataattcccgatgctgaatcaaaattgaagctgaaattttggaaagaagctctgtcctccgcaccttcgcgacgtttctccttaaaccagagcagatgatcgtccggagacttcatccggttggtccacatgaaataagacatttccagatagtccttgatttcttttccggataaagtcatcatatatagcatattctcatacttatacagattgaacatatcgctgacaaacacatcacctttatttattttcgcatcaaatgaaagcggtgctgcaaaggatatctccgcaccggtgatatcaagctgcaaggtatggatcaagtcgataaaagcagacggtccgaagaaagaaggacaggttgagatactctcggtgaatgtaccgatctttttagagacaaagttacggacagtgtcatattgaggagcaaaatgcttcataaagtcctcgctgattccataatctttcgtttcggtcaatactccttttatatctttgctgcgcaccttcccatctttcagtttcaaggtcacatcgatgttggacagaacaattccgttgcttgccggatcaatgaccagtactgaatcacctgccacattcatcactttcttacattcgcgcgcatgatcgtgtcccatcagtacaatgtcaaatccggggacattcttcgccacactcagagaagcgttttcattatacttgccggacattttgaaagcctcctgccccgcatggaacaagccgatcatcaagtccggattctctttttcacggatgatcttcatccatttgcgtgcagtctcctccatgtcgtcgaaacgcagtcccttccacaggttctccgagagccatgcagggatagcaggggtgatcattccaaggattacgattttcactccgtcacgttccatgaccttataaggaggaagatgaggttctccggtcgatatatcgatgatattagctcctaatacgagaaagtcacaggtatttatccagcggtcgaacacggctcggcctgtctccacatcatgattacccatatttccggcatcatatttcatgtagttcatcatttccgcgcataggtggggtgatactgtatctatataattatagtaataggcagtcggttgcccctgcaatatatcgccgttgtcgagtaaaataagattctccttatattgttcgcgttctttctccacaaaagcgtatattcgtgccagactgccctgccaatccttacgggtaataaaattataaggataataattaccatgtacatcacttgtctgtacaattttcagcttcactactttttcctgtgccgcaattgagagcacgaggcaaagaagccatacgtaaacacatgcaaatcgtttcattctttttctattttaagcggatgtgagaacatgaaccgtgcacctcccgtatattcggagtcgatccatatatcccctttccatttatgcacaatcaatttacagatagataatcccaaacctgttccctgggcatattcgttcagcttctcgaagcgctcaaataccagtttctgtttctctttcgggatgccgcaccctgtatccgtcacagagaatacagccatctccgtctcttcattcaccgaaaattccagtgttatctgccctttcctggtgaacttatccgcattagacatcagattgataatcacctgctgcatacgctgtatgtctgtcgtcatccgaaacgactcataatcgctgacaaacaggaactgattgccggactgccgtgaaacgctgacagatgccaccacctgcctgcatagctgcaccacgtcacactcttcccaagtcaacgtgaccctgttcgcttccaggcgtgagagatcaagaatatcattgatcaggcgaagcaacaaatccgaatttgtcttgataatctgataataggtctgctgttcttcttccgtattgccacccacagcgagcacatccgagaaacctacaatggagtttaaaggcgtacgtatctcatggctcatattggcgaggaaagcacttttcagacggttcgattcttctgcacggtccttagccacccgcaggtctttttccgacttcagcagatcgtccttcagacgttcggtgcggaaatagtagaagagcgagatgcacaaacccagcacaaggatgagaaacagtgcacacgccgaccaaatctgataagtatattgctgatagaatgatacagtctgattaataatctccacatcaaaaggaaggatatccgggtccagtccccactccttcaccttccggctgtccagtacggccttgctgccaatcacggaaaggtgctgctgttcatccgccggatattgatcaatctgtacagatgccaatgccatgtcctttcccagtttccggtaatcgggcagcactccgccgatcgcccaataccccagactcaccgatgagggagtaaaagtcggaatggtcggagtaacctccatcatggcataagtagcattccgcatgaaataaccttcgttcatatccacacgccacgtgcctaccatgatcaccgtattctccggtaaatgacgcaattcttctacaatcgtatagatagtatgccgccggccgtccatcaagatcaggtcgatttcgggaaacttcttcatttccttccgcaccagtgcctgcatggtgacgccaccgtaagtattgtccgaaataaaagcgatgtgttccgtcttcggataaaacaccttgatcatccggacgttatcttctatattgtactgattgataaatcccgacttcaattccggtatattcatgtggtcggtaaagagatcgaccgattccggcatccatgtgtccagtccggcaaccgtatcctcgggcagtatgacgatgttactgctgacgagactacacatcaccggcaccttcacctgtatcgaatcccgttgcgacagatacgccgcccatgcttcctgtcccaacagaataatctgcgccggatgcttctccccttgatatttagaaagaatctgcgtcatcataccgctccaaagcggggcttcggagaaacttttgcagttcatgttttcaatgataatatcgcgtttccctcccaatttgctatattcttccatatagtcggagatagtgaccgaagtttgatgagcggcgggattgtaggagcagataatcaggatgggtttctgatcgttagagacagcaaataacgctgtggcccggaaaagccatagtaaacagataaacaggcatcctatatatctcatcatacttgtaagttttgaagtgttactatctcattttagcttgcaaatatactaaaacttgtcggctataacagatttatgtgtatttttgtcgctcattcattcacaaaaaaattgtttatggaactatttcatcaaatgatttccggattactgggaattccggaaagacaaatcagcagtaccctccacttgttgggcgaaggtgccaccatccctttcatcagccgttaccgtaaggaagctaccggcggactgaacgaagtacagatagagaacatcaaggagcaacatgacaagttgtgcgacatagccagacggaaggaaaccatcctcagtaccatcaacgagcaaggcaaactcactccggagctcgaaaagcgcatcaacgccacctggaatcctacggaactggaggacatctacctcccctacaaacccaaacggaagacccgtgccgaagcggcccgtcagaagggactggaaccactggccatgatcatgatgctgcaaagggagcctaacctcaccgccaaagccgccaccttcgtcaaaggcgacgtaaaggatacggaagacgcactgaaaggtgcccgtgacatcatcgcggagcaagtgaatgaggacgagcgtgcccgcaacgccatacgtaaccagttcacccgtcaggcggaaatcaccgccaaggtagtgaaaggaaaagaggaagaggccgccaagtaccgggattatttcgacttctccgaatcgctgaaacgctgcacttcccatcgcctgctcgccatccgccgggcagaatccgaagggttgctgaaagtatccatcagtccggatgacgaagcctgtctggaacgcctcgaccgccagttcgtacatggcaataatgaatgcagccatcaggtaaaggaagccactgccgacgcctacaaacgtctgctcaaaccttccatcgaaacagaatttgccgcccagtccaaagaaaaagccgacgacgaagccatccgcgtatttacggagaatctccgccagctgcttctctctcctcctctcggacagaaacgggtgctcgccatcgaccccggattccgtaccggctgcaaagtcgtctgcctcgatgcgcaaggcaacttgctgcacaatgagaatatctacccgcatcctccggtcaataaaaccggtgaagcggcctccaaactccgcaagatgatagaagcctatgaaattgaagccatctccatcggcaacgggacagccagccgcgaaacggaagactttatcaatcatcagaccttcgaccggcagattcctgtattcgtggtcagcgagcagggcgcttccatttattcggcatccaagatcgcccgtgacgagtttcccgattatgacgtaacggtacgtggagcagtctccatcggtcgccgactgatggaccctctggcggaactggtaaagatcgaccccaaatctatcggtgtgggacaataccagcacgatgtagaccagacgaaactgaagaaagcccttgaccagacagtggaaaactgcgtgaacctggtaggcgtgaatctgaataccgccagcagtcatctgctgacatacatatccggtctggggccgcaactggcacaaaacattgtcaacttccgtgccgagaacggagctttctgttcacgcaaggagctgatgaaagtcccccgcatgggtgccaaagccttcgaacagtgtgccggcttcctccgcattcccggagcaaagaacccgttggacaacacagccgtgcatccggaaagctaccacatcgtagagcaaatggcaaaggacttgaaatgtagcgtagacgaactgatcgcgaataaggaactccgccaaaaaatcaagatatcggactacatcacaccgactgtgggcctgcctaccctgcaagacatcatgcaggaactcgacaagccgggtcgcgacccgcgtaaagcgatcaaggtatttgaattcgacaagaacgtgcgcaccatcgcagacttgcgcgaaggcatgattctgccgggcatcgtaggcaatattaccaatttcggagctttcgtcgatataggcatcaaggagaacgggcttgtacacctctcccaactggccgaacgatacatctccgatcctacagaaatcgtgtccatccaccagcatgtcatggtcagagtgatgaacgtggataccgaccggaaacggattcagcttagcatgatcggggtacagcaagactgatcgcctcacgtttttctccccaccaaacaattaaaatcgtaaagataatcatcagtactgtacaaatgagcgagccttcaaacccgaaggctccgccattcagtacgttctcttcgggcagatgcagcgtcagcagggatgtcccaaagtcatttccacttacctgatagcccagtatcgggccctgaatccagttccagaaaagatgaagggaaatagggaaacaaagattgcgcgtatataaataggaagcgccgataaacatacctgcaagtaacagattcagcataggcaggaaggcaaggttcggattgaagaggtgcagcaatgcgaacagcagtgcggagacaaaaagagacaggaatttattcatccgggtatgcagcagacggccgagtatatagccacgcatcatgatttcttcggccagagccaccagcaggcagaacacaaaggtagcaagcagattcagaggatcgaactgaaaaccggttacttccacctcacccaaagccaaagacagtccgaagccgatcaagtagagaaggatggctgccagcagtccgtaccacaatccccgtgcatgacctttcagtgtcagtcccaggtcagagaaagggcgacgctcaaaatagagcagaatcactgccgaagtcagcacagccagcagcatgccggcttccgccaccatatgccccaacaatccggggtgccttgcctcatcaccaagaatcagagataaaactccgaagcctatcgtactatacaatccaaaggtgacgaaaagccccagtgcaaacaacaggatgcacgcccatacgggaagtctcttcggttctttcttttctctgatttcttctgtctccatttttactttttgttaatcacgctacaaaattagatataaaacataaaaaaacatcgtgtcttacctatttttcctatatttgtctgaacaaatctgtataattatgaaaataagacaactactgataagttttttattggctgccagcacattgggagcaaccgcacaagtaagcaaaacgtattatgtcagcaagcccggcacactgatctcgatgatgacggaagaagaagctaacagcatcactcacctgacactgacaggaaaactgaacgcagaagacttcagacatctccgcgacgagtttcccagcctgaaagtgctcgatatctccaacgccgaaattaagatgtacagcggaaaagccggcacgtatcctaacggaaagttctacatctatatggccaatttcatccctgcctacgctttctcgaatgtggtgaacggagtaaccaaaggtaaacagacgctggagaaagtgatcctttccgaaaagataaagaatatcgaagatgcagccttcaaaggatgtgacaacctgaaaatctgtcagatacgcaagaagacagctcctaatctgctgccggaagcgctggcggacagtgtgaccgccatcttcatcccgctgggcagcagtgatgcctaccgttttaagaacagatgggagcactttgcatttatagaaggtgaaccgctggaaacaaccatacaggtaggcgcaatgggcaaactggaagacgagattatgaaagctggtctgcaacccagggacatcaacttcctgaccatcgaagggaaactggataacgccgacttcaaactaatccgcgactatatgccgaatctcgtatctctggatatttctaaaacaaatgcgacgactatccccgacttcactttcgcacaaaagaagtatctcctgaagatcaaactgccacataacctcaagaccatcggtcaacgggtattcagcaactgcggacggcttgccggaacacttgagctgcctgccagcgtgacggctatcgagttcggagcgttcatgggatgcgataatctgcgctatgtgcttgctacaggtgataagattacaacgctgggcgatgaactcttcggaaacggggtgccgagcaagttgatttataagaaataaaagatggtcctttacaggatatgatatttgctgccagaatagcctatatcactaaatgccctgagataaaataactatcatgagttaattatctcagggcataataataaatacggtatcagatggatttattcttcctgttttatggatatcggaggataaatataatactcctcttccgaatcactaataattatatcaaaaggatctttcttttttatctcaataatatcacgaggataaacaatactatcaatcattgacttatcttcaaactcatcaagtctacgttgataatccgcttgtatcgggacatacacaaaacggcattcctttaaataattataaagttgtctgacccagtcttttcctacactactccaatgatgtaagaaaggtctaaatacaggatgatcctcggaatcttccacaccttcaattgttgcccaatatgcaatagtatcttttctattattaggaatcaaagaaccataataggtaaataatgcaatagtatcggatttgtttatcattaaaaaacgacctatttctccatagtctgaactatcccaagcagggcgataataatgtttggtattagaaccaaacaaaaccggtttatgggtatggttatacatcaaaaactcaaaagtcagactcacaggaacagtgtcccctataattcctccttgaggacttggatggatattacttctcgatacatttaacaattcaagttccattgaaagttcttttacttgagcatgtgaactcattataaataatataatactaaacacacataatattcttttatttaccacgtttgctgtaataaagattatacctttctttaatttcatcttgttgatatttaggtaattttttaaaagtgggatgattcaattgagcattatagcatttccagtgagtacttgttttactccagttcattattccatgcccataatactcatgaacacctaaataattctgaatactctccactgtatataaatcatgttgattatagccagattctactgtcacccgaattttcccttttacatatgtcgtagaatatttaggcttctctttatgtccatatgggtcattataaccttttcccatatattcattaagacctactctgaccacatcatccacaattgacacttcacctttataaagcccagacatatcaagcttagcatctgtacttttcttcaatacatctgtatatatatgagcctgagaagcaagttctataacgcttgttttcaacggaacagtattcttatctccctgtatcttctttgagtcagcaactcccttatttgagtatttatcaaaagtagctttgttagtaatgtaaatcgcaccggtaaatcctttctcgtctacgcccaggaaagtaccatcttctgtatagtaaggagaagtaaaagtacctgtcgggtctacaaactttatcggatttcccaaacaataactataaggcgaccagctataatacttctccgccatcggatcaatacttgtaaagcgtccggagacaacttccatctgtcgggcatcataatcataccagttcaaaccattattcatatccaattccttattattatatttataaggttgtttatctccgtgagtactctctgtaaacgacatgccgaaaggataataatgatttgtttgaattaccgtcccgtccgacttagccaccacacgattattgcccaaatggtcctgcaaatagaatatgccctgagataaaacaactatcatgagttaattatcccaaggcataataaaatagacaaactaccaaacttctagccaatatatgacataatttttaaaaatagtaacgcctttcgtatagccatgtaaccactctttaggaagacctacaccggatctagaaagattatcatcttctaaaaagcgcccttgcttagcatcaagaacataactagttgcatctttataaaaatcaggtgaaaaatctatgccccaacgtttaaaatgggggataggtagtatgtgagcagcattacaattatgtagtgaatcagaaaacacaactgtaaaattattataatcatacggtatagtcattaaacaagaatcagttaaatgataaacagctttggcttttgctactaattctgtttttaatgattgcgtttcattatcatccaaagacaatcctaaatgaatgtaattcagatattttcctcgtgggaattgaaaatgtgttattacatctgctcgtttatctatcttattcggaaatcctaaaacaaggtcgggaggatacaagcctattatttcttgataatatcgtatctgccttttatcaggatgtacctgagatgagcaagctcccaaaagaaagcctaaaactaaaattattaccttcataatttatttcatataattcaatactcttcccattcctctagtggcttttgaatagtcatccctatttctataaacattaactgcccgatagtcttgtttacctgttgtaatagtgctcattattccaaaaagcgttccaatagcattataaattttatcttccgttttcgtttttttatatgtaacataattcctttcaacataattcgttttctttcctcctgttaacagaatatcgagcttgcctgtcttttttaacgactctgtaaacaaaggttcggttttaactcccacgactttatccttgtcagaagtaaaaacaccatatctttcattcacaatttctattttccccgttgtgattgatacgctctttttaccggtagtgtaaggttgctcccttgaatcttcagatgttatatactgtatcggattaatggcataaccatgggcttgagctaagcttactgactcttcataatcatatgatttttctgttatatctttcatatcccccagcatattgtttgctccaactcgggtatatagattatcgttaaaagttatctgcttctgattcattcctttgttataatataattgaccagtagcttcatacaaataccaatcacgaccatccaaatctatatttttgataggattattattgcaataagcataaggagttactccatggtatttctcacttgatggatctatcacatgccatcttcccaaagccggatcgtacatccttgccccataatcataccagttcaaaccattattcatatccaactccttattattatatttataaggttgtttatctccgtgagtactctctgtaaacgacatgccgaaaggataataatgatttgtttgaattaccgtcccgtccgacttagccaccacacgattattgcccaaatggtcctgcaaatagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtcccgtccgacttagccaccacacgattattgcccaaatggtcctgcaaatagaaatagtaagtaccattctcaatgtaaccaccatccaccaatatacgctttaaagaaccattctcataaatcatattaccgacataatcagtacgattctctgcggaagatttatgaatgacggatagcttctttccatcggcagaataaatatactcatgagtagatttgtttgtgtcattgaaagtaatccgttttggcaaatttaataaattgtattgaatatcagctatacttttatttaaatctttaatcagattaccattttcatcatagaggtattccacatcctgattcgtgccattcctgaaatccatagatgatgccggaagatttgaatctgacgcagtatcttcaacctttattaactgattaccacggtaatttagagttaagttatcaattactccataggcagcattctgattcccggaacgcatcagagagactatattaccctgcttgtcataactataagaagtgttgaagttatgattgcgaatattattctcaagatagtccgcatggagcaaacgggaaagattgtcataagaaaaatcataaccacgctttttatcgccatttacattccaatccataccggagatattaccattataataatgagtatttgtttggttgggacgggcgtcattataatataatgtctcactgaacagaggacagctgatcgattcagtccatgaacggagattataagtataactcgtatgaagattggcttgaccattacgcctgttacgttgcagacgtcccagttcatcatattcattattgacaagagtcattaccggtccattattcaaacgatgcgtagtggtttgcagccggtccgcataatcataggtatatgagtagagttcggtctgggtcgttttgccggtagccgaatggatatgtttatgctttgtcggctgaccgataaagttataagccatatagtctttttcgactccaccattcaggtgactgcctgacttgctttgtattaccctgtcgtgatcatcataatacatcacggtataaagataagattgccctttctcatcaagacacgctgtcaggctacccgtaagtatatcttgagaacttgccgaataacgtttgccaaagccttccgtctctgcactagcatcataacaaacgccggcatctgtgaaaatcggaaaaccgtttctacccaagaaagagtaatcatcataatacttgactgaaagcaagccgggagaagtcaaagtaagccccgacaggctataacctttatatggtccactgccgatagcagcagtagaaccggaataccaggaggcattgacgacggaagaaagtaacggatcggaaaaaggatccagtacattcctgcaaatgcccgaaaaacattcacgtccaaacatatccggaatgctgaacgaccattcgccacgactatgctgattgccgtcctgagaaaaaatcagccgccttcccttgtcatagatataaaaagaccagctgcagcccggcagtttcttggctatctgaagtttacggctatcatatttgtacaaaaaggcatattgcagaagcgttgcatccgtattacttttccagcttgtagtgctgccgctgccgagtatggaagcagcagccggaggaagcaccgctacccgattgccaaaatcatcatatatataataagtatcatacagctccttgttccctccggtctgcatgatctgacgagtcaagacaacctgtcccagtttgtctttgaactcgaaagacggattcccatcttcgtctgccatacgggtaacataaagttgtcccgttgcataattaccgatgcgactgatttgcataacagtatcacttgcattcgttgcagtgaaatgaatgcagtttaatgtatccgtacctgctatattggtcaggtagtcacttttcacactatgatgattatcctgccagtcttgtccgggaccgtattgttccagcatacgatccagcggagaggcttcatataccggacgagagtaaggagcattatcaccatacgtggctgtcgccttagtttttaccacatcaggaagaatgaactttcctccgttatttgggaatataacaggcaaccattctctggaggtacgcccttggggatcatattcctgatacatcaccatgttattattattattatgagagtatctcaagacagattgctccaaacgtcccaaaccatcataatagtctatcttatcctgccatgcaactcccgtctcttgagtgtatgtacgtgtagctatatggttcttgtcagcagacaataattccatccatgaattatttgtctgggcattactttctccggagagtaatgcgccaataaacatacaatataaaatcttcttcatatctaattgcattttaaaattaataagtaaacggatatccacctataacataagtatcctcataacccatataatctcccatgttataatttatatcaaaagcataaggagtggattttatagaaggtacttcgttggcccagtgattatcttgaggtgcaacacgagcgtttcgataatatcttctaggaatataaactttagccggttcataatcgttaaggacatctcctgtatccgcaatcttgcgactgggtggtatttcataataatcagtaacaatacttccttgaactccccaatcaaaggtcaggaaataatctttttcaaatggattataaacagatatgattatgttagaattacattccgcatgttcgttagcatattgttgcccattattttgcatatcgatataggctttctgattggcatcttcctgtgataaagttgagctatatttctttgcaggcactacataattaatagattctcctctttctcctaaagatgcgtcacaagtattccgggtaaaagtttctctgatttccttattataataagtcacttcaggttctacggattgattctgataaaaataatcatattttttaatgacattcatatcattatccatcacagataccagcctgctaaagtcatcatacctataagcctccgttacgcccctttcattagtcgtgcttcttaatcctatgaggggataatagccatatgtagttatcgaagcatccttaggatatacacggacatcatctataggatatactccttcatttattgaatctcggccgttaacaaaatcatgcttcatatattcccactttccattcttaaaaacctgataatctatcacatattccctttccggattagttgctaaagaaaccgtataaggaccgatacaactattactactatgatatccgaaagaagcaggacgtaaatgagtggtttcaaagttttcatagaatacatcatctgcaccacttgtttcgggggcaatactttttcttgtccaataggagaaatgaatatccccatcatatacacttgtcgaagattctttacacgcatcagtactgagaatactaaatgtatgataaccggccgagacataaaatgtagcactgtacgtataggcattttgatagtcagtccagggcctgcccatctgatcagagcttctcacctggaccagattgaaagccttattgtcaagatgtcctgacacataccagttaaatcccaatgctccggaaaggactatttcaacatcccctgcttttgatgtataaaaattatatgattctacattagacgacaatgagttgtatttcagctttacatacttagttgttctctcatctctgtattgaggaacagacttgaaagtattccgggcatttacaactttagctactggatattgtccattgtatccccagatataggctgtatttatgccagtcttatccactacattagtcggattaccatacgagtcataatcaagatattccatctcaagcgcacatcggttgtccatagaatattgagttgagttcaacagtttaaaggaagagtaattacttaacggcacatcgctctccaacttatactgcttatcctgaacagcgaacttatcagactgtttgtatgtcatcacttctgccgaagtgactttcccattccgcttaacaaccgtttctacaggataagacaacaatccttgcgttctcattgtatcataaatttttaatggagaaccagaggagataaaaccggaattgctactatcatactcttccatcaaatcagaaagatatttggatcttgtttccagtatgctgttatcattcggattgttagtatactttttcgtagccgtcagcaagcgatatttattgtattcatattcttccgtctcgtttatattgccataatcggtatagagaatcgtttctttcttttgcaagaaagggaaataggtatatatcttgttggcactgactcgtataggaagagtattcataagtgcatagcgctcaatcgttttaagataatctgataaatccgaatgataggtataagcttccttctttatcaatttctgtgacgcattataatagtctgcagatctcaaaagaccacgatcaagctttctcgatgtgtatttgttatacatatcgttattcattcctaaagtaaatgcagctgtagaaggctcgtcttgcacccggtcataatttgtaaaagaataaatagtctttgagccatcagatcgtttttctatcaccctagaatatcccatatgaaagccgtctgaccagtttatattagtggtagctttattactataagaatacggtccctttaaatgtgtatatttgaagtcataatcaacagtaccagtatcacttgtgacataccagggaacaactgacagaataccactggaagagttatcttcattttgatataaatattctttcgttatcttttcggataagtccttataattcgaataagtaattctttttacccgcactccacctgccgttccattttcctgctttaatccgaatggatattgtgtagatattcttgaataactatgcaattcatattccagccctactttccctcctgtagggtagattattccttccagaatttcagctttcacataagtcggatctggttgtctgtaattataaagagcatcaaagcgttgcgagtttatcagagaaagatacttcttaccattataatatccccaattgtcggttaacatctgattaaaagccggtaatttcaacgcattatattgaaatttatatttctcagtattgttgaccaataaagagtcaagtttcagccgttcgccaggttgatttgtatagtagaactttatatttcctgttgtcgctttaatttcatccaacttataggaataggctttctcttttattttatcaataacagctccatagttgtcttttaaaaataatttctgctggtcatagaaaccatccgtcaccaaatcgttcctttttgaggaaacaaactccagttcatctccattactagccttgatacctgtcaacagagacggataaactatatcatatttcttatctactaatagcaaaaactgaggatcaacagtagaaggaagattataaaaagcgggaatcgtattcgatttaagattctcaccggaaaatttaattgtagaaatattatgatgatccaatctttctactatgttcacatgctccttatcataattaaaaatgatattttcctgattaggtaatattattttcttgatatgccaagtggatgctgtacctagtaaactggagtgaaaactatcccaaatcatgctatggctccctatctgatcaccatatacattatagtgactatcataatcaggatcttcagaatacgtacaagacagatcaatacaattaatatctccaccaaagatataggtgactccttccgaatcaacaattgttatttccgtaatcaacacaggtcttgactcgatatacagcttgggatgatatgttttgtttagatgaatattagtccattccgtttctgcaagtaacacatcagggattttgccaatttttacatccttcactttaaagcattgactattttgtgatgagattcttgtttgtatttctccttccttatctttatacatataaaaggaagcatttattttccctatacttattacaaattcatccaagtcgggctcatgaagataatcttcattataaatgaaaggattgtaatatttatttaaattatactcctgattccagttcgtattactagtcctgtccatatattcattaaacgtataggcttcatcaatcataccattagcgactctgtatatttgcccgccagtaacagaccatcctagtcccacattgccaacgggtagatcgactttgttgccttccgaattatacagtaactgtatgtcatacgaataatttttaagtcctatggaatacaagggaatagaaacattcgcacgtcccgaatataaatcgacaggtaacgactgaacccgtagcaatgagccaacttccggagccggagtatcatattttagcattgactgagaaaatataggctggagaagaaaagtaaaaagaaacatgaagtaatacctcatcttcctgtcggttagttctgataatataaatatatttttcatatactgttctttagtttataaaactcaatagattaattaaaaagaaatcacaggtgatacaaaccgctataacttcgtgctactaaacagcactaaattatctcactgtatgacctgtgattaatacttacagattcatcgcattaccgcccaacgctcccagcactgccgaagccaccgcgatgactactttcaaaatggtatcccaaagggatctcttgactgccataactttacacacctcctttccgacacataaaatggttgattactaagtgaatcatctttacatgattgattactcctgaaaactttcctcctttacctcaaaacacgggcacgccttgatccactcctccggctcaatctcaccgttcccattgcgatccggcgacaagtcgcgatgaccgcacacccggcaaccgggaaatctctcttgcaactgatgcaccagcagccggagcgctgcccgctgttccggtgtccgtgtgtccgccgggcgtccccggcagtccagaccgccttcgtagcaaattccgatactctccgcattaaaacctttcgcatgtgccccgatccgttccaccggacgggtaataagcgttgttccatccttgcggatatagtaatgataacctgtcccgtggaaaccccgtcggcgatgcatcgtatccagatcaaaagccgtcaactccttgtctgcccgcgtagcggaacaatgaatcacgattaaatgaatcttcctcataaagtcattaattctaactatcaaacccttgtacattgattaccaactctccacttcttacactgtcggatccggagcttcctcatcgcctccgtctccaccgcccggattcggatcaggaacttcgccaccgtcgccggaaccgccttcaccaccgttcagcgccttcagttgctgttccaagtctacaaaatccagacggtcttccgcacgggtggcggcaagattgggacgtacactggcggatgcacggaaattgatgcgaacccagcggatgttctccggcagacaagccttcttcgtatcagtacccactgtggtagcggacaggctgaataccccgaaattctcaatattcacggcatggccgttgtacaactcgcttcgtgtcacttccacgaagttggtcagtacactcttgatgtcgcccagggtgagcgaactcttctccttcatctgcttggcaatggtattcagtgtggcaggttttccccaggtgatcagctgcggataatacttgcctgtaccctctttgtcaaatggagactttcgtaaaatctttttaaatgttacagacattgttttcttcttctctttttaataaatgaatttcttgttattttctcttcgttccccggatgaaggttgcggtgacgtcttccggcttctcctctcaggaacacgacaaaggtagtgaacaggctatccacgagggtaagtatatgtacataccggtctctacaagtaagtactgagacgtagtttgacgaaatgaatgctactgttacctacttatccatacccgtatcattatctttccatcaaaggaacattattctgtcaaacggctttgatttgtcagaataaatacatatctttaccgtataatcaatcaggcggatagccgatataaagaataccaatgatggaaactgcacaagaagaatttcaaatccgggtatacctgaagacagaactggcacaactgtacgcaccccacttagaccccgaagccgcattgagaaagatgcgaaaatggattcaccggaaccccgacctctaccgcgaactgtatgcaggcacggaaggaaagaacgaacaggcatacagcaaaagacaagtggctattatagtgaggtatctggaggctccataagcactgaagcttcactttcggagatttctacattattatatacacgcaggcgcgttagaacattctatttaatactaaaaaaagcgtgtaactgagggtaaggtccttaccctcggttacacgcttttttcatattaaatatattgtatataaagaatagaatatagagattaaacagacacaaaaaataagttgtacctttgcggcatttttaaacataacactttttaacaacaactctaattattaaaatcatgagtaaaaagacattttctccgaaggctttgtctaccagaacaagcaggctataacgctcgaaaagggagaattccccgccatctccccgtttatcactcaactgctggacaatatcaacagcatgtacatcaacaggatagaggtaaatccatctgacagaaagaagtttcttgcccccatcgttcacctctgctacgacccttcctctccttttaacattaaagggcctaaattcttcgcgcagttgctgtttctgacagtaaacttccggaagaacgatcagtctaatgaatctttaagcatagaagaaattgattatgagatacaaaagatgaaaaggctcctgtccgacgattaacattttgcagattacgttaaaaaactgtttttaggctcctaaaagcagtttttttattacaaccaaaagctattcctttgcaaaacattaataacgaaaacaattaaaaatcatcaaagaaaatggaaaagattactgtaaccacatacaggggattatcgcaggtgtcaggaagtatcagcctccccaaattattcgaacatatgcggggagagatatatcgggacagagtccggagaatccgggaggcactaacgtcgggagacaccgggaaagcagaccggatgaagaagcaactgccttaccgcaccgtcacagccacctacagcaatgaaagactcgcttacagcctcgaaacttatcaggatatcatcactctcgactttgatgatatggaggtagaaaagatcccggaataccgccggttggcgaacgactgccccgacacgctgggaaatttcatcagcccccgcgagcacggactgaaaatcttcgtctacctcaccggcgaagagccggaagctctacgcgccgaactgaacgcgctgggaaacatcgaccttcccaccttagagcgatatcaccaccgcatgttcgccctggcagccgacaagtaccagaaactgctcaacacgaaagtcgatacaagcggaagcgacctgagccgcggagtcttcgtctcgcacgatccggacgcctttctctccctcgaacgactggagaatgtgaaaccgctcacaatcaccctgacattgccgaccgaagaagaatgcaaaaagaagaaacgcaagaaacctctttcactcccatctctcctccccgcacaagagaacgcgaccccgatcgacctgcaagtgcagctcgacttccgcaaagctgtggaatacaccaaacggaaagaacgcctcgaacccggcaaccgcgacaacttcttctactgcctcggcaaccagtgttaccgccgccacatcatggaagcggaagccgtcagcctgacacgcagctatttcggcaaccttcccgacttcgacttcgaagcgcctctgcgcaatgcctaccaatacacctcgaagacggatcaggcagaagaggattctaaggagccgaaaatcttcaaagtcatcagattcttggaccaatattacgagttccgcagaaacatagtgaaagaacaaatcgagttccgcccccgatcggcgtcgactgccgaccccgccccctccgccttcatcaccctacgcaccaaagacatcaacacattctatatcaatgcacaaatgaagaaagttggctgttcgcaaaatttcctcaaagcattggtcgattcggattactcgaaaccgttcaaccccttcacccactatttctattctctcccgtcgtgggacgggaaaaccgattacatcacccaactggcaaaaacggtcaaagcagcagaccagtccttttttgaggacagtctccgccactggctggtaggcatggtggcgtgcgccatcaacgatgacgcgcaaaaccaccaactgatgttactttatggcgaacaagggaaaggtaagagcgtctttatccggcgtcttctgcctccggaactaaaggggtattaccgccacggcatgatcaaacccgacaaaacagaccatctgctacagctttcttcctgtctcatcatcgacttggatgaatttgacagcatctcaacctggcacatgcaggacctgaaaagactcatcacacaagatgaggtgacagagcggaaagtttacgacatacagacatacaactacgtccgtcgtgcctcgtttatagccagcaccaataatccgcactgcctgcaggatatcaaggaaaacagacgtattctcttcaacactatcctgaaagtcgactatcgtaaccctataaattacgaaggagtatactcacaagcgttggcgctttatcaacaaggatttcagtactggtatgataaagaacagatcaccttcctgaacgaccgcaacgagaattaccgcctgaaggacccggtggaggaaaatctgtttttctatttccgtgcggctaaaggaggagaaataaatgcgcaatggtatcccgcttcttatatcctttcaatactgagcgtgaacggacgcacccagtccaaccaacaggcacaaaagatattggtcaccgtgctcgaaaagaataatttccataaacgggtcacctcggacggcgttacggaatatatggtagtagagtattcgcgggaagagcgcaaggctaattcgacattgccgcagttgccgaaacaggggaagtttgagttgtaaaaacggggagcttcgggatgataaacaataaacagtaagcacactcgaccgtgaatgtaggataggatgttacggaagctaacaagcaatgaaaaggaaagggaaaagcaatgttacgacagttaacaagcatttccctttccttgacagtaagaaggtgcaaaagtcagtgtatccggctgatacaacacgctatttatcaccgtacatcttcgccctcaactccttgatatggtccgaagtgatatattcgtcatattccatcatcttgtcgatgataccgttcggagtcagttcgataatgcggttggcaaccgtctgaataaattcgtggtcatgcgaagagaagaggatatttcctttgtacgtcttcaggttgttgttgaaagcctgaatagattccaggtccaagtgattggtcggagtatccagaatcagacagttcgcattgcggagctgcatacgtgcaatcatacaacgcatcttttcacctccggaaagtacgctgactttcttcagtacctcttcgccggagaacagcatacgtccgaggaagcccttcatgtacacttcgttaccttcaccgaactggctcagccagtccaccaggttaaggtcagtgttgaagaagtccgtattgtccagaggcaggtaagccgttgtgatggttaccccccagttgaactgtccggcatccggcttcatgtttccgttgatgatttcgaagaaagcggtcatcgcacgcgggttgcgtgaaaggaataccactttgtcgcctttttcgatgttgaagttcacgtcgctgaacagcactacgccttcttccgtcttcttgctcagtccggaaacttcgaggatctggttgcccggctcgcgttcgggagtgaagatgatgcccggatacttgcgtgaagaaggtttgatttcttctacgttcagtttttccagcatcttcttgcggcttgtggtctgcttgctcttcgctacgttggcactgaaacggcggataaattcttccagctctttcttcttctcctcagccttcgccttctggttctgctgctgacggagcgccagctgactagattcgtaccagaaactgtagtttccggcaaacatattgatctttccgtagtcgatgtctacggtgtgcgtacatacggagtcgaggaagtgacggtcgtggcttaccaccagcacggtgtgctcgaagttggaaaggtattcttccagccaggtcactgtctccatatcgaggtcattggtaggctcgtccagaaggaggttgtcggggttgccgtacaatgcttgcgcaagcatcacacgcaccttttccttaccgctcagctcgcccatcaatgtataatgcttatcttccttgatgcccagaccgctcaacagcatggctgcgtcactctccgcattccatccgtccagctcggcaaatttctcttccagttcggatactttcagtccgtcttcgtccgtgaagtcttccttggcgtacaatacttcacgctgcttcataatgtcccacaacacggtgtggcccatcattacggtgtccattaccgtataagcatcccatttaaagtggtcctggctcaacaccgacaggcgttcgcccggtcccagggcaatcgtaccggtcgtcgggtccagatctccgtagattgtacggaggaaggtggattttcccgcaccgttcgcgccgataataccatagcagttgccacttgtaaatttcaggttcacgtcattaaacaagactcttttaccaaactgcaccgaaacgtttgaaactgtaatcattttctattatttactattttaccagttactatattattatttgagcgtgcaaaggtagacatttaaaatgaattatgagctatccggaatgtgtcaatctggcataaatgtattacctttgccacgttttttggcaaaacggtcagattggcaaagtttttgcttgagaaattgatattatgaataaaaaataaaaataagatatggatccaaaagaaaaagaaaagatggctgaagagctgaatgtggaagaaacaaaggatacggcggaagaacaaccgcaaaacgatcaggcagaagaggccgctcccctgactcatgaggagcagctcgaaaaggagctggaagatgctcaggctgtcatcgaggagcaaaaggacaaatatctgcgcctgtccgccgagtttgacaattaccgcaaacgtaccatgaaggagaaggcggaactgattctgaatggtggcgaaaagagcatcagcagcattctgccggtgatcgacgactttgagcgtgccatcaaaacgatggaaactgccaaagacgtaaaagccgtgaaggaaggtgtcgaattgatttataataagttcatggctactcttgcacagaacggcgtgaaggtcatcgaaacgaaagaccagccgctggataccgattaccacgaagccattgccgtcatccctgccccgtcggaagagcagaaaggtaagattctggactgcgtacagacgggttacacgctgaatgacaaggtgattcgtcacgcgaaagtggtagttggggagtaaatacaaaagttagtttagttaagaagcatggcagaaaaaagagactattatgaagtgctggaggtgacaaaaaccgccacagtagaagagattaaaaaagcctaccgcaaaaaagcgatccaatatcaccccgacaaaaatccgggtgacaaggaagcggaagagaaattcaaggaggctgccgaagcgtatgacgtgttgagcaatccggacaagcgttcgcgttatgaccagttcggtcatgcgggagtgagcggtgcggcaggcaacggaggtccgttcggtggtttcggtggcgaaggaatgtctatggatgatatcttctccatgttcggtgacatcttcggaggtcgtggcggtggtttcagcggcggcttcggaggtttcggcggtttcggtggcggtggcggtggttcacagcaacgtcgttatcggggcagcgatctacgtgtcaaggtaaagatgactttgaaagaaatctcgacaggagtagaaaagaaattcaaactgaaaaaatatgtgccgtgtaatcactgtcatggcacgggtgccgaaggcgacggcggttcggagacttgtccgacctgtaagggtagcggttcggtgatccgtaaccagcagacgattctgggtacgatgcagacccgcgccacttgtcctacttgtaacggtgaaggtaagatcatcaagaacaagtgtaaagagtgtggtggcgacggtatcgtatatggcgaagaggtagtgacggtgaagattcctgccggagtggcagaaggtatgcaactctcgatgggcggcaagggtaatgccggaaagcataatggtgtgccgggcgacttgctgattctcgttgaggaagaaccgcatccggacttgatccgcgacgagaatgatctgatctataacttgctgctgagtttcccgactgccgcactgggtggtgccgtggagattccgacaatcgacggcaaagtgaaagtgaagatcgactcgggtactcaaccgggtaaagtgctgcgtctgcgcggtaaaggtctgccgaatgtcaatggttatggtacgggagatttgctggttaatatcagcatttatgtgccggaagcattgaacaaggaggaaaagagtacgctggaaaagatggaggcttcggacaacttcaagccgagtacgtcggtgaaggagaagatcttcaagaagttcaagagcttctttgactagccttctttggctgggtctgtttttaagatcatagtcattctcacagagatataataaaggcttcggtgttcgttatgaatgccgaagccttttagtttgtattgggatattatagcaaatgaatggatgaatccggctaatatcccggattctgctccagttttgtattcatcacccgtatcttttccggaatcgggaatacagtagtatatccattattctcagcaggaagttgcggacgactgctgtatgctctcgtgaacgctccgaaacgaatcaagtcctgccgtcgccaaccttcccaagccagttcgagctgtcgttcggcaaggatattttctaatgtagccgttcgggaggaagcgttgacacgcccgcgtacttcgttcagctcggcatctccgtcttccccattacgaacctttgcttcgctcttcatcagcagaacatctgcataacggaacagtacaatgtcgttctccatcagtttaccgtccttggtagccgtttcgtctacctcgtactttttcatgcgtgctcctgctgtctgctcatagggagtattcgagatatccagttcgactttccacggcaaatattcgagaacggttccatcgtccagacggactatatttccttttaaatcatatacgactccggcaaaatagcagatatcgaaacgcgggtcctgttgcgctgtttcatagccgaaggtttccagagcttcgatagtagcgctcggtccgttttcaccgctcagtccgtaggctttggcgtgattgtaatggcgggaacggaaaaggtattgcatctggttggtgtacaaggtcttgttcatcgggatggtgaagatattctcaacagacggttcattgaatacggcaaagttggttttgtaatccggttccagacgatagcccatttcttgcagttggtcacagtaagcgataaccgtctgccaggcattgaggcggttgccgtctacttcgaaaaaaagattctttccgtcgggacgctggccgtccgtccagtcgttgtcggtatagacttcggcattcaaggcaagctttgccaagaggaaaacaactacaggacgggtgattcgtccgtaatacggaccggactggttgctgtggacttcggccagcaaaggggcggattcttgcagttctttgaatacaaagtcgaatatcgttttccgttcgctctgcactacgtctttcatcgacggggatgaggtaagtacaagcgggacacgtccgaacagatccatcagataatagtaatacatcgcccgcatggcgcgtacttcggcacgataggcgggaagttcggcgtctgcgtgggtagcactgaatttgtctattcgttcgagggatttgttggacagcatcaccactttataaagatattcccaagtggcttggatggcatcgttttctattccccattggtgcaggaacagaccttgccaaaagccgccgtcgtaccaatcgccgccacgggtggggataatggcttcgtcggtggtgaaggtgttcaggtcatagactcccctacccgtcccctgcaatccctgactgtcgctataaccgccgatgtaggtgtaaagtgaggctacggcattcagatatacatccgagatattgttgtagacttcatcttccggcagtttgtctctgggactctcttccagaaacttgtcgcacgagaagaaggtaatgcacacaataagaaagacaactgtttttttcaggttcatcttcccctcaagcagattccccccaagcagagttgcttttccatcatatagagatttactctctaaataccatccttgctgctgcaaatatcgctttatctttttcattattgttttcctcctccgttaaaagttaatactcaatcccaacgtgtaagtccgcgctaacggatatccgcgtttgtcgtccagccccaaagtggagttgaccgtcgagctgttgatcatgggcgaaagacctgaatagccggaaatcgtcgctaggttgttgactgtaaatgccagtcgcagggagcggacatatttctttagtttctgcaccttttctatcggtacgttccagccgagtgtcacgtagtcgaagttgacatacgctccgttttccagccagtagtcggtggcggtctggtctttgatattgcgtgcgggagcttcctgcatcacattgtagtcggggaatatgttcatgttcatataggtcagggaggttccgttgtatattttgtgtccgaaggcgccgttgatctgtactgaaatatcaaaacgcttgtaacggaaactgaggttcgatccgagaattgttttgggtacggcttgcccggccacatagcggtcttcgccatcttcgaggctgacgccgccgccattgaggtcggctatgtcataggtgtagccgccgtttccgtcggaaacgagtccgttggcacgtggcaggtagaagacacccagcggctggcctactacttgataaacgatgtggttataacctccgtgaaagccggctccgtcgaggctggcaagactcttgtattcgggggcggaaatcagttcgccattgtacataccgctcagagaaagcaacttgttctgctggaaggtgatgttggcgttgatattcagttccatgtcctgagtcttcaacggggtgatgccgatggctatctccagaccgctgttgcgcatggagccgatattcgccagcagggtgttgtaggtaaagggcggtacgcttacgttgtagaggtagagcatatccgtcgttttggagttgtaataattggcggagagcaacaggcggttgccgaacatggcaaggtcaatacctgtattgaaggtatgtttcacttcccatttcaagtcgggattcgtgtttcgcaagtctcccaatgacacggctgccgagtttcctacgggaatcactccgttcggtttgacaaggctcagcgtggtgtaggagtcgataccgctctgattaccagccaaaccgtaacctatacggaacttcagattatcaatcacggggaggcgtttcatgaacttttcctcactgatcacccatgcagcggagacggagggaaagaatccccatttgtgattggctccgaatttggaggaggcatcggtacgggcggtcattgtcagactgtagcggtcggcataggtgtagttgaagcgtcccatgaaggaggccagatgcggttgctcgtagtacgagttggttccctcccacggacggagagcgccggcttgcagattgtggtagccgaatttatctgtattgaagttggtgactgtggtatagaatccggtgtatgtctccttctggagttccgccagtgccagcgcgtcgaagtaatgcttcttccagcctttcttgtaggtcagcatcatgttacccaggagggattccatctttttcgtgcctttgtatgcctgtccgtgcgcccagacggaggtgggcagatattgggaattttcgactatgttataggtataggcaccgaagagaaccagtttcagttcgtccatcagattgaaagtcagacgagcgtgagtactgatatgcgaggtggcgtcatgatcctgtacttccatccatgccaacggattcgtgatctgactggcggtagtgattccgtcccatgaaccggaatcggggtctttgtgattggggtatgtgggattgaaagtggcggcagaatagaaggttttctgaaggtctaccagattgtgattcttctggatagaaccgaacatgcccagttcgcagttcagaaaaccgtcgaacatcctttgggtcatgttcatattagaggtgaagttcttcatgtcctcgttcagtatgactccctgacggtccatgaaaccgagagatacacggtagctggattcattcgagcctccatagaaggcgatgtggtggttttgctgcaatcctgtttgttctatctctttctggaagtcggtgttgtttcccttgtccagaatggagatgccccgttcggatgcaacccggcggaagtcatctgctgacagcattttcagattcttatagacggtggatattccgaagatgccgttataactcacttgcgttttaccgctcatgcccttcttggtggtgatttcgatgacaccggaggcgcctcgtgatccgtactgtgccgtttcggaagcgtctttcaggatggtgaagctctctatgtctgtaggataaatggaggtaagcatactcaaatcgccgaagactccatcgacgataatcagcgggtcgtttccgctggtcaatgaggtggttcctcgcaggcggactgcatctaaggcggcgggaccgtttgtcccacgctggatggtcagacccggtactcgtccgcgtatggcttccagcggattcgtgatctggtctttattcatctgtgtctccgtgattttctccactgatccggatatggtttttaaacttccggtggcgtatcctaccgttatcagagagtctatcggagtgatcgtttttctctgggcaaaggcacttccactggaagtgatcagaaagaaaaggctccaaatagtaagtctgtagtgttgtttcataattatcattttttaagggataatacaaatataacaaaaaaagcgggcatctggttgtccggatacccgcttttctttgatatgggatataaaaattatattgtcaatgtagatgaatacaacaaaccgcttgattggggaaaatcaagcggtcggctatatctgactgactatatcttgggggatatactgtggtcaatcagactgaaacaggctatcgtttattctcaggtttattcttagaaccggattacgatttagcacctttttcctgtccataaccgtatccgtagccatagcgtttgccatatccatagtacttgccatacttaccgtagccgtagtagtagccatacttcctgcgtttcaggtctacgccattgattacagtacacaggttaggcagtttcttttcttcggcaagttcgttgatcaatgtatactctactttatgagtatagtcggcacggcatacgtagacggacaagtccgctacacgaccgatcaataaggtatcggtaaccatacctaccggtgcggtatccagaatcacatagtcaaagttcttcttcaatatttctatagccttgtccagaccatcacgcgctaacagctcggtcggattaggaggaaccgttccaccgggaagtatatacagattctgattaatatccgaaggttgtaccagactcatcaaatctgtttccgggtttgcaaggtataaggtaatccccttctctttcgtcgaaagacggaagactttattcaatcccggtttgcggatatcaagccctacgattactactttctttcctaataaagagagactgatggctaaattggcggagataaatgattttccttctccactgacggtagaagtcacaagaatcactttcttgtcattctgaagcatgaactgaaggttggtacggatgtttcggaaggtctcgctcatcaggttgttctgattctcaaagacggcaatagaaccgtctttttcgttcttctcgtcggttaatgggatatcaccgacgataggaatagttgtcagtttctcgacatctgcacgaccttcgagtttgaacttggtcaggccgatcaggtagatgatgcctacggggatgccaacacctaatactaaagcgatcagataaatcattctacgcttaggagaaacagggatatcatcagcgatagcttcatcaatgatttttgcattgtttgcagtagctgccaatgctatggcgttctcctcacgcttttgtaaaagcatcaaatacagtccggccttgatttcctgttgacgggcaatacttacaaactgacgttcttgtccgggagcatcactaatacgacgagaaaaacggcttgcttcacgttcaagatcagcttttgtaattaataaacctttcaatgatccgtcaagggtcgcctgcacattcgacttcatggcacggatgcttgtatccagattgataatcgtaggattattttctgtagaagtacgtaataagcgcttccgttcaactaacatttcattatatcgttcaatcgttgcaaccaatcctggatcttgcaagcctatattacccggaagaacttcgtattcatttcctcttatatattttcgcaaatcttcaataaggctgatttgtgtccggttctctactctcttcttttcatattcggcgttaccggtcaaggcaatttgcgcttcactagtcaagtcggtaataccggcattacgtttaaaattctcaagatttgcctctgtactcccaagctccttagaaataatattgatacgttcatctataaattcagcagtcttttgagcaatctcatttttatcattattcgtattacggttatacatttctaataattgattgataaaatcttgcccacgttgcaaactagagttcttcaatgaaatcacagctaccgaagtcgttttagaagtaggctcaatttttagattttcacaatacgcccgtgctactttcataggtgatttaatcttagccgtaatatgccgtatatttgaagacgcttccattgtatctttcttcaatgataaggaatctggcgattgaaaaaaggctaaagttccctcatccatcgggaatacagctggcaatttctcaaaatgcttttggtattctttatcaccaactgtaacatttacatccaaaccaccttctccatacaacgccatctcaacaaccataggatcagttagtttctcagcttcttgcggagtcaaactaactaaaacaggagaagttttatacatattctttgaaggaaatccatcttcatctgtatatgatacatataagtttaacagattgattacttctttcactaaagtctttgaacgtaaaacttcaagttcattatctatattctgagaagaactaatcaagccacttaaccctaattcttccagtcctaccatacttcctgtattgccaccttttttgtcatcctttatcaaaactgttgccgatatattataaacaggagtggccatacgcaaatatatccaagctccaataagacaaactaaaacggcaccgacaaaccacggccaatgaataatatatttaaaaagtaattgttgaatatctattttctcgtcctcagtttcacactgtctttcgtttactatttcttctttcattttttcaaaacgttattttaagatattaaataataagctggcaagagaaactaggatagatgtagcagagaaccatagactcgtactattcccaatatccgagttacgagcttttgccttattaggtgttacataaacgacatcattttgctgtagccaataatatggagaaagaattgtttctgatttattcaaatcaagagttataatttcttgcttacctatggcatcttcacgaatcagttttacattatcccgcaagccatacaccgtcatatcccctgccatagcaagcgcctccaataaattgactttttcattagaaatagtaaaagtacccggacgagtgacttcacctatcactgagattttataatttaccatacgcactgtaacgataggcgtttctttcatatagggtttcaacttttctacaaccatttgttctgcctgtttctttgtcaaaccacctagttttaactctcccaatacaggaaaaaaaatctttccttcattatctaccaagtaagtttgtaacacaggttgtgtagtagctaaaatattagtaacagacaaatttgttggactggcaactgtcaaattaaatggtgcagccaactccggactagtacaggaaactacgatagtcaacaaatctttaggcatgatctttgcatcatacaaattctctttctgttctatttgatttactacttctgtatcctgcaaataaggtactttcttgtaggactggcaggccgtaaacagaaaaggcagtaacactacaaaaatcaatttattcaatattctcataactgtgatgaattagatatctattcttttatactttgttgttttattactaattaatacgcttctttttctccatgaatagcattatatactgttttataaataatatacaaatcaagcataaacgtccaatgctcaatataccaaatatcacgactaacccgtccttccatttgccaaagttctttagtctctccacgatagcctgttacttgcgcccaaccagttataccaggcttcacaaaatgacgaaccataaatttattaatcacttgggcatattcctctgtatgtttcagcatatgggggcgaggaccaacaacagacatatcacccatcaatacattaataaactgaggcaattcatcaatactcgttttacgaataaactcacctatacgtgttttacgaggatcatttgctgtagcttgaagaacatcacattgtgcatttactcgcatagaacgaaatttgtaacaccaaaattcacgaccgtcttcaccactacgtttctgtttaaaaaaaatgggccccggcgagctgattttaatagcaatccctattattatataaacaaaagggaaaatagtacacaagaatatcaatgaaaatattatatcaaaaaatcgttttaaaacacgattctcacgaagttccaatggttcacgacgaatagataatactggtacattacctaataaatcaaaatacatcctgcgctttaaatagttacggacattgggaacactaaaaaaacgcaccaagtggttctcgcaataattaatgatcggaacaatctccgcactccgtacagaaggaagactacagtagagttgtgcaattttacctgaatttctttctaaatactcaatcgcctctttcggctgtcccaaatatgcaacttcttccggataataatcggatggggaatcttcaaaatatcccattacacggtagcctgaagttggatcatctgtcattgaatggtaaagttcctgcatattctcgtgactgcccaccaatacaaccatgcgaacatttcctcctttttcacgataaagttccaaaaaataacgaaaagcaagacgataacaaatcaagatgatcagtaaagcaacataaaacaatccgaacaaccgagagcggaaaaattcaaaatggaaaagagacaaaaagcaaatggaaaataaaataaaaggaaccatattacgaagtacacgaatcataatctgttctggacgaacaactggatgatgcaaaataacccctgattgaatattgcaaaccagatagcatagactaagcagaaccatcccttgataaagagaagttaaattaccagaataaaagcgactgcccaaaaccagttcaaatccccatagcaatgaattcaacaaaattatatccccaaaaaggacacaagattttaaaactttattaaaacgttggatctcctgcatagaacgatgttatataatagattttaatattatttctataaaaccacatttattcttctaataatattctagttttgagcaagcttgcattttagaacaaaagcttccaatcgaacatccatgtttcttaaagaaaacaaacatactctgtaaatgaagaagcgcctttcgaccgattttagaacttccacgaagatggttatgagtcattatagattcaggaaaataaatgacaggacgattacatttccaagatcgaagacaaatatcttcatcttccatatataaaaaataattctgatcaaacccacctaaaaaagcataaaaatctctccgcataaataatgctgcgccaatagcccaatctacaggttgtatctttgttgtatccatgtttttacaaagatacttattcactatcttactggttgtttgatcattacctttagataaaaatcgagagaacagaacttttaatgtaataaaacttctcacagaatattgaactgtcccatctggattcaatagttttggtacagtaatgcctataataggatgcttttcaacatattcatatagaaaatctaaactccctttatgcaaaacaatatccggattaataatagcaatatatttccctattgaggctaatactcctttattattattttctccaaatcctaaaggtttttgattctcaacgatccttacttgaggataattttgtcggatatattcaacagtaccatctgatgaacaattatccacataaatcatttcaatacttgcttgaggaatattctctttatataaagaacgtaataatactttaaggtataaaagatggttcataccgaccgtaataatagaaatatcaatcatatttatcgaggattaacaaaggaaaattgaataaattaattccaaataatatatctattaaactaaatatatagactttcactatatgattgtagttatattaaatctggcagtaaagactaaacaataaactcacacatatcaacaataaatcactcaaatccttttaatatagtttgttatggaatccgattgatatgtcttaataaacatttctttcgtttttattctttcatctatattcatattgagacattccatacatctaatataatcctttggcgtctcagcaatgagcataaaggaattaaataaaggaggaagaccttcaaaagcaatatcagttccaataacaggaatgccacatgccaaagcttctataaccttgactttaatacctgcccctgtaaacaatggggatatcaaagctttactctgagataaaatcttatatggatcatctacaaagccaagaatatctaaattcaaattcggaactatatttttcacatctttattaggaaatccacgtcctatgattttaatatgtactttttttctcaataatggacctacagtattaataaaccacaaagccccttccgcattttctttacgccgccaatcgccaaacattgtgaaataatcctcaactttatcgggacttttattaataatttgttcatcaatatagtctaaacaaagattagtttccttatgataaatctgttttattaggtcacaatctttttgtgaaaaagaaaaaatatgagcattaggcagattcaaggacatccgttccgagaaaatacatatcttctgcattaaatatgaagaagaacgaagcacacgttgtgcaattacatcatggcaaagtaatattttaggaatacgtttatcaatatatcgtccatacaagaacatattactatgattaaaaatcacaactttataatgattcattttaagcaaatccctaactcttcgaagtatcagccaattaaaacgtatagaaaaagtaggatgaacaaaaggaaagttgcaaacattttttaatttagtcattatcgagttacgaattgttagtttcgtatttacatttcctctttcgggcacataatcattttcccaatcatatttaaaataaatcaaatcaacatcataacatgaagctaaatcattcagcattatcatagtgtttttttcacctgctgctgccttattgggaacatatgctgtcaaaaacaaaattttctctttcatataactttaattcctacaataccacaattcttagcaaattttatatcactatcactatcacctatcataaggcacttagctttatcaatatctggataatctctcaatatttgaagaaacatacctattcccggtttacggttaatatcagaatccgtcaaagcggtacaataataaattctatctattctccctccataattcttaacttcagaaatcattcgctcatgtatatgttttaaatcctcttcactcataatttccttccctactccacgctgattagtcactataaatatatatttaaaatgggtattccaaactttcaaaatttcaagtactccaggaagaaattcaaactcttcccattttttcacatagtcatctggacgaagtctgttaaccactccatcacgatctagcaacaatgtttcaaaaccagttacatcaatatcttgtagtctcattatagaaagatttatttagaaaaggagatctgaaaattccgcattggccttgtcgtaatcttcgggaataccaatatcaataaaatatccattttgcaccacaccataaagttttcctaataaacattggggttgaagaactcctgtctcaaaagaaaatctctgcggtagtctgttgaatatcggttctaatgtattgataatatatataccaccattaatcaagcctttctcgcaatattttttctcatcaaatcttctaatctgattagtatcttcacatatctgtacatttccgtaacggtcaaagttttccattggctttaatgccagtgtgattgatgaaggatataaacaatgccattcatataattcattcaaatttacatcaaagaatgtatcgccattcaaaacaataatattaggtttactagttctctttaaggctagttttattcctccacctgtccctaatggttcgtcctccacggcatattcgaaagcaaaaggaaactcatctttacactcatcaatccaatcaataataacaccgcgtaaataacccaaagatagaattacttttgatacatcaaattttgtaagatatttcagtaaataccacaaaaaaggtttgtttgctattggcgccatacacttgggtacttcatttactacactacgcaaacgagtcccaaatccaccagctaatatgataacttccataaaattatttattatattcttccccgaaaatattctcttccacaatacagcaaataatatgtcctattaatgtttgacattcctgtatacgaggggtttcagcactaggaactttaatgacaatatcaaaatcatccattttacaagacttcatacctgtaagagcaatcgtcgtaatccccttttctttacatataggcaaggcatctacaatatttttcgaattacctgaagtagaaataccaataaaaacatcccctgccacaccttgtgcctggagttggcgtgcaaatattttatcatatccataatcattaccaatagctgtaataacactggtatccgtagttaaagctattgaaggaattcccggacgatcaaaataaaacttactcacaaattcgccgactaaatgctgagcatcagctgcactccccccattacccgcaaacatcgttttatttcctcgacgataggcctcagtacatacgtcagccgctttagcaatagccgctatcacttcttcatttttagaaagttccgctttcactcgctcactctccgctacttgttttcttacaatatcaatactttccatacttatgctatatctatttctgaactttatctgttgaataaatcttccatccgtgtgcaccgtcatcaataaactgaaatggcataacaaaaccattcaaattatttaaagcccgtaccacttcttctttacgtgtcggctcaaccacaaacatgataaatcctcccccacctgctccactaaccttaccggccatagcaccggcaccagtggctacatcaaaagcttcttgaatcatcggattagtaatggcgccagccatcttcttcttattttcccatccttcacccaaaatacgagcaaactccccaacatcccccttcaacaaggctaatttagtatcaatagcactctgtttaatcttatgcatcgcctctatagcggtttgattaccttcgctcgtatttttcttctgctcattaataatagcagcagaagagcgagaacgacctgtaaaatatagaaccatacttgactctaattcatccacaatccaacgtttcatttttagcggattaacaatcaccaaatcattttgcaagaattccatataattgaatcccccaaaagctgctgcatattgatcttgcttaccaccactcaatcccaaatccttacgttcaatttcataagctagacgcgacgtctcgtaatctcctaaaggaagtgacaaccactcaataaaagcctttaatatacaaacaaccatagtagaggatgttcctaatcctgatccagcaggcgcatcattataagttgttattttgaatgacttaggctcaagcctataatcacgaataatacggttatacacaccttttatgagacttgcttctccatcaatctctaattgagacatagaaaggtaacttttgcaacattgtgcatcataagcattaatctcaatcctaccgctgttggtctcttcaatagtacaataagcatataaattaattgttgcattgagaatcaaccctccataaatatcactataaggtgatacatcacttccaccaccagccaatcccagacgtaatggcgctttacttcttacaatcattttattgaaatatataaattattcatatagtcaaaaatatagaacatcctttactcttttagctagctgaatgaaacgatatgtccaattaatgataaatgcatcattgaaggaaataatattttttccaaccgccttatctaataagaggcgtatttgagattttgagattgcttgagaataatgtaccactaaacgaaaaaaagcatactttgtaaatcggtagacagatgatttatgaaagaactcatttatccaatgagtaaactcaatatcagcagtaagcttccggagcaccattttattatccatattaggtgttatattttttttgctcttacgccaatatacataatctccagaaatagttttaatacctttatcagctcctattttcacccatgtagctatatcacttccccatgctaaatcaaagtgctgaaaaccacctgtacaattataaatatcccttagaaaaatatactctactacaaaactatctaaccgagccgacgctttccgacgataaaaagtctcactatctatcaccgatggataaacagttggaattctcactatctgattttcgcaatcaacaatctttacatcaaaatgataaatgtcaaaagctccattatctattgctattgtattaaaaaaatattctacacaacgaggccccataatatcatcatcagaaaacagccacagccaaggctcattctgtgtcagttgtatacaacggttccattgtgcaacgagatcatgcccaccaaaattcacttcaaatcttctataaacaatatccaattgcttcgaatattgttctataagactcttaaaatcatctctactacaatcctcaccaatataaacagtgaaatctttacatgtctgttgcgctaaagagaataatacagtctcaaagaagtctaccttataggcaggtattacaattgctaattttttcattaatcaactttatagaaaatgaagatatgtccctcccaaagtataccgcaaatcaatagaacgttgcgccaaaacttttgctggtattcctccacatatagtaaaaggcggaatatccttagtaactacggcaccagctgctatcactgctccctccccaatagtaacactatgcaaaattgttacattagggccaatccatacacggttctttatataaataggaccacgattcgttttcatagatcgaaagtatggatcattataatcatgaccacctgtccaaagagaaacattagaagcaatattaacgttttcaccgatatagattcctccacgcctcgcatccagaatactattatctccaacgacagaaccttttcctatcatcaacatccatggtgcacgaatttcacttccataatataatactgaattcttttccatttttaccaagaaaatatacttgtaaaagaaatcacgtatatgatgtgaaggaatatccgaaattattttgatcatccaacgaaaataaccatccacaatattgatcaatcctcttttatctattcgtttgaacaattttttagaacaagaagaagaagtaatgccagaatccctaatttcactcacctcaccttcaggattagccatgtttttgcgacgatgcagccaacaataagccattagtaaaggagaagtaaatagcagtaaccaatacttaataaatacaactattagtataaacagaacaaccgataaattcataatctcattatcgtttcaacatttcattataaatattcaggcgccgctgtacagaagcttccggtgaatacatctccattagtttctcatgagcagcttttgtcagattatgttgtaaaaccttatctgttgctatttttaaaacaccagtagcaaaagcttgaggctcatcagctatgatacactcttttccatttataaaatcaagtccttctacacctactgtggtagtaacgaaaggcgaatagaaattgaccgattctaatattttcatacgaataccgctacctattaaaataggtattaccataatacattcagatataaccatagccaagttatctacaaagccacaaaaaaacaaatttctatacttcttctgatattctgttttaattttctcatcccattttcctataattttaaaagtaaaattgggattttctttgagtatcaaagaccaaacattatctaagaaccaagtaactccattcaagtttggattatgaccagaaccaccaataaaacagatactactccgttcacattccttatatgctatattatcaggtaaaggaataaaggaaggagaagctgaaataggtgctcttaccccatcacacatcaggatattcttatcaatatcagtcattgttattacttggtcgtattcatttaacgcattaatttcctgtatccgttgcatcgtggctaaatagcgtacgctagaaggatattcacgctgctgaatcagacgttccttagcaatgtattgaatttcatgttgaatgaacaccttctttacagtattaggaatagcataaaccatatatagctgttcaaaatattcattttgaacaatatcaatccgctctttttttataatttcatttacaaaatcaatataagcatctttatatataggtgtagccaaatatggctgtttcaaaaatttccgggttataatacggtgcagacgaaataatgagtattgcgacttgatgccatctttatttttataatattcaaaagggtaaactttaacctttggtaattgtttttccaacaaatattgacaggccatttgtttcttaaagaatacaggatagatcaaagttatatctatcatattctgcaactccattaacatattaaacgacccctgctttcctccgtctgtagcaggataaggcatccatggcaatgtaataagatatttcataaaacattatttagacttaaaaacttccaaaatagaactcatcatttgctcatagttattataataattcaaagctgttttttgacatgctattacatcaaaatgtaatattcgattaatcacaatatcaacaggtggacatttccaaaagcgagaatacgcattgatacgattatcaagtaaagaaaaacgtgacataatatcataaattttactcgattcttcgacacatacacaacgtgcatatttaagtacaccataggtatcaaaacaaaaacatggtactgcattatgtagagccacaacaataggatgcatattttccccaatatatcctttagcatattttatcaaggcataccaatctaatggaggtagcggagtagtaatagaaaaatcaaaattatgcttaaacccaataccagtcggcataggaagagcaacacattctaaatatagctttttcatttctgattttaatttatccatccatagcatattatcaagcattctacatttcatgcttacaagaacataattttcaggcaaatgatattttaaaagaatatcttcttttgaaggaatgaatttagcacaattataattaaaggcaaatactggatcgggagttatatttggtattattgccccttttgttatataagtaatcatatcacgagtccatatatctcgaaccgaaatatattcgaagtgagacaaattattactcattttatgctttaccgaacgcgctatcaatctatatttcgcattctgtgatgatgcagacataatcaccattggaattttagacccaagtttatcataaaatgtaccccaaaaagcattaggatactcacgttcagatgtagttttattaacacgtacaactgttttggttggaaaatccaatctaccccaaaaagacgaacactgaagaactgcatcactgccaataattataccttctattttttcatcctttatcacttgacaaatatcatcatcattacgacatattttggtctgcggaagatatttctctacaaaatgaaaatgctcttgtggttgcttctgagttttaatacttgtgaaacgagcttcaaaatcttctggctcccacttaatcaaaataggattatatccgtgattctgtagatagcttatcgtagatagtgcttgtaaattagccccaaaattagggacattagcaaatgttagaattccgatcttcattatttattaatatattttcttgtccgatacttactaaataaaaagcagaaaaaaagagtaaacaaaatttcaagattcccccaatccccttgaagaacaaagaaaaaaacaccattgatcagtgtgtaggctaacattcccaaagctatgaacttaggcagtgtcagtacattgtaaggtcgcattttctttaccataaaaaacgataaaagcaaaccaataacaatagtgccaacaaaaccaaactcaatattcagaccgcctacaaatgtatagaatacatgggtgtcaacacctgtaatattatcaagccactcccatttttcacgtgttgttttaaaatttgaggaaattcccataagcttacgaaaaaaaacaaaatatgcctctccccatgtattaccttttaactcatagaaaaaatgtgtattataattattaaaagactctcctaaataccgataaaacatataagtggcaagattaccaaaacgagagttggatataagaataaaggctgaagaaataggaactaagattaagattaaataagatacaatcttttttttcaatcctacattcataaaaacagatagaaacacaaaaataaaaactaaaaagaaaaatgtcattatcattacggctctacttgcatatgctgtaaacatatatacaggaaaacataaagaagtgacgagaaatatcttaagaagttttctatgtgtttttatgacaagtaaaccgtaagcggcaatcaaaataacaacattgcgtgcgcccatatatagacgacataatatgttaaaaaaataatttggaaattgtacaatctcagattcatcatatgtatcattacgataatcaccaatatttgaagaaagtattgcttttaaaaatgaaggaaataaaataatatataacactatctgaataaaaagaagtatccaaaccaaatttatgaagaagttagaatttaacgtttcaattcgagtgattctagtattatcatatctgataataggatatgcaaaaagaaaaataacaggtataagatataaaaatggtataattgaatacgtctccctcccccgcatataatgaaacaactcgtgctcatgatacagtaatgctccccatgcacaaatcgaataatatgccaatatatagaaagcgatatttaacttcctatttttccaatagtggtaaactgctaatatagaaaagacagcagcgttaaatatcaatatttgtaattctgacatttatttgattttttgttcacccataaatagcttggctattattggagttttcttaatactcttttaataatttgtttcactatttttttagtgataacatatttgctatcaccaaaatacttcttatatgcagcatcaaaccctcttaaaagataaaattcccaaaactcttgtcgtctttgattagaacatgtagggcgaattaagcatggctgcatagcttcatctttcgttatcttccacaaatcaatagaatcgtaaagtttgtttatcaagtctaaccccatattagtattcaccattaataatgaagtaccttcacatgaatacaaatccgggcgattcttcttgtcgtcccaaaaatcagctattgtaaaatctccaggacggtccaagttagaatacttacaagagtgacaagaaggacgatttatcatttgagaaaaaaatatttttccccaattaactacccaaacaggatcgacagctttctggccgttttcaaaataaaaacaataagagaagcgatgactccacccataagtttgtttgtacctcatgttgatagacatgaccttttggccaagtttcgtcgaacacatatttatatattgcttatatataagtggactaggaacagcatggcaaactaaatcaaccgttagtaaattctcatatggtttacgtaaaaaaagcttaagcccttctacttgacaaggagaacctgtaaacaaaacccagcgatcgctttttaaataagtctttatctgattgtaaacaccttgaatttcactctggacatattttgaccccataaaactccttataccttccatcgtttccgaaaagctatgtctcactactccatcgttatcatattctacaccacaaacaacccctcccaattctattacagatcctgcaatagctgtaaaagcaccaccactagaactgttccgtaacgttacaatatttttatggcgagctgcaaaatatgcttttggagttggccttatatccttcacctttctataaagaataggacaagccatctcacaaagtccacaattgatgcatttaccttcctcaatcataggatatttaaaaccttccacatcttccttaaaaactatcgcattatgattgcagattgacaagcatgcagaacatccacaacaatcctctgatttttttatttttatcatgatcctcaacagcttatttgatatgattacaagttattttttataagcttacgcacttgatcaacgacaaatactctttcacttgctttgcaacccacaaaaaagatagccataaatgagcatatgatacatgagaaagataagatcaagaacgaataaaatgatgattgtaatcgtaatgagattaaatagggaattgcaactgaaaatatcgtcacagcacatatattaaagaaaacattcttcatatagcttttaacaggcaattgtatcatactacgaagcataaataaacgaagtgccaaacaacataatgatataccaatagccacataaagagtaatttctggtgcataacctcgttctaacaatatatatgaaataggaaaattcatcatttgcataccgcctacaactatttggtaatttctaatactgcctgttgccagcatcgcagtaatcaaaggatttgatattgattcacacatggcaaagatcaagactaaacggacaaatatgattgtataatcaggaacaatttttaaccatattgataatatatattctgtactcatgagtactggtaatgacaaaaatagtaacatataaaaagataatcttgccccctgaaaaatcaaagtaaacatgtatttactatcacctacagcaaatgattttgttatctgtggatttaatgctgtcataaagttttgagcgaaactattaattgcatgattaacctgtacagccatccctcttgcagcattgacagttggaccacaaaaaagatttatagcaatatttacgccttgatctctaaggattgctgaagatgcccctataaaattccaacccgaaaagctcaacattcttttcaataggaatctatcgattcgacaaaaacatttacattccttaaaatgtcgcctacaatatataaaataagcaaaggttataacaattgctaccaccaacaacaaagccccataaacaatcaatttatctactgacattaatactaataaataaacaattaagagtttaagtgacacctccagaatactaacataagcaaatgcagacattcgttcgtgtgcaataattaaagcattaaagggaatacaaatcaaattgactccaaaggtaaaaattgagaactgaagcacccaatttgccgcattcatacgaacttcgggtatattcattttattattaagaaaccacactcctataagctcagcaagtataacgaccactaaagccattaaaaactgtataactactgctgtagaaaataccgtcttcagtcttcgtagatcacctttgcccaactcaatagttataaagcgactaatggcagaagacaatgaggtagatataatagcaaacatagttactactccccctaccacattataaataccaaaatcttcaacccccaacgtagctagtaccacacggctagtatacaatgataccatcatggtaaataacatacggaaatagagaagaaaagtattcttagctattcgcttattattgtaattagtagttatcaaatataaaacaattattcagtaaatatccggaacttcgtatccaactccaactttagatgtttacaacatcaaaagctatttttcatattagtactttaattattatgtgaataaaaaggctctatataaaagagaatattcattcattcctatatatggaatcgtaatactcctgataatcaccacttgtcacattgtccatccatacctcattatctaaataccatctcacagtcctttcgagaccttcttcaaactgcaaactcggctcccagcctaactcttgtttcagcttagcggagtcaattgcatagcgtagatcgtgcccctttcgatcagaaacatatgtaattaaatctaaggaataaccttcgggataacctagtaacctatcaacagttttaataagaaccttaataatatctatattcttccattcattgaacccaccaatattatatgtctctgctattttacctttgtgaaaaataagatcaatgccccgaacatggtcgattacatacaaccaatcacgaacattttctcctttgccatacacgggcaatggtttacgacagcgaatattattgatgaataatggtataagtttttcaggaaattggtaagggccataattattggaacaattcgttacaattgtaggcatattataagtgtcgtgaaaagcacgtacaaaatgatcactacttgctttagaagcagaatacggactgtgtggactatacctcgtggtttccttaaaaaaatcatgaccataaggtcccctaccgtccttattgccactaggattcgttaaatccaatgcaccataaacttcatctgtagatatatgataaaaacgcttgccttcataaccttcagaaagagactcccaagttaatttagccgcttgaagcagagaaagggttcccattacattcgtacgagcaaaagtaaaaggatcattaatactacgatctacatgactttcagcagccaagtgaataaccccatctatcttatactcactaaacaactctatcattttttcaaaatcacagatatcagcctttacaaaaacataattaggcttatcttcaatatctttcagattagctaagtttccagcataagtcaatttatccaaattgataatacgatagctgggatatttattcacaaacagacggacaacatgactaccaatgaaaccagcaccaccagtgatcattatatttcttgagaatttcatgattaattattttctttaagttcattaatacatttcacaagagaatctttccaataaggaatctctacaccaaaagccagcttcaattttgttttatctaatactgagaaatgaggacgttttactttactaggaaattcatcactatggcaaggttgaatatcacaactatttccactcaattcacagatttctttagcaaaatcataccatgaacaaacaccctcattactgaaatgatagataccttgtttgtgatattgatccccctcaatcactctataaataatatcagccaaatcttttgcatatgtaggtgtaccaatctgatcaaaaacaactctcaatttatctttatcagcggttaactgtcgcatagtcttaacaaaattcttaccaaattgagaatacagccaagctgtacgaaaaatcaaataattacagcccacacgttggatgctttgttctcctgctctttttgttttaccataaatacctaaaggattagtttcacagtcttctccacatggcatattcttatcaccttgaaatacataatcagtcgaaatatgaattaaagtagcattaacttcttttgcagcaatagccaaattctctacagctttattattcaataagtctgccatatcataatcatcttctgctttatctacattcgtataagcagcacagttaacaattacctttatattatctaaatgtatcatattacgaatagcatctaaatctgtaatatccaactctgcaacatcagtaaatatataattattcaaacttgtagctgctatgcatcgcatttcattaccaagctgcccattagctccagttactagaatattcattatttaatatagactttcattatagttaaacaaccaagaagcatctttcaataattcatgatgattatccttctcagacaaaacaatctcatttgccggaactctccaatcaatacccaaatcaggatcatcccatgccaaagccccttcactttgcggagcatagaaattatcacatttatattgaaaaataacttcatccgtcagcacactgaatccatgagcaaaaccacgaggaataaaaaattgacgatgattatcttctgtcagttctacagacacatactttccaaacgttggtgagcctttgcgaatatctaccgcaacatccaaaacagcacctttaataacacgaactaatttactttgtgcataaggaggcttctgaaaatgtaaacctcgtagcaccccataactagacttactctcattatcttgtacaaaattcactttacgaactttctcgttaaattcccgttgcgagaaagattcaaagaaatagccacgatcatccttaaacaaacgaggttcaataatgaacacaccttctatagctgttttaataacttccactgtgattattttgaaaattaagtattaagtttatttctgtgttaactcatcaattacctttaacaaatattgtccatactgattctttagcataggctgggccagttcgcgcattttatcagtagtaatccatccatgacgtaaggcaataccttccaagcatgctaccttcaacccttgacgtttctcaataacttcaataaaagtactggcttcagataaagaatcatgagttcctgtatccagccaagcgaatccacgacctagcagctgcactttaagttcctgatcattcaggaattgctgattcactgtcgtaatctctaattcaccacgcaatgacggcgtgatatttttagctacttccaccactttattcggatagaaataaagaccgactactgcataattagattttggctgaacaggtttttcttctatactcagaacattccctattttatcaaattcagcaacaccataacgttcagaatcggcaacccagtatccgaaaacagtagctttattctcttcttctgcagtatgcacagcttctttcagcatatgggtgaaaccctgaccatagaaaatattatcacctagtaccagacaaacggaatcgttaccgataaattcttctccgataataaatgcttgagccaatccatccggagaaggttgctctgcatattcaaaacgtacaccataatcagagccatctcctaaaagacgtttaaagcccggaagatcataaggagtagaaattatcagaatctcacgtataccagccaacatcaataccgaaataggataataaatcattggcttatcaaagatagggagcagttgtttgctcactccttttgtgatcggatacaaacgagtacctgaaccaccggctaaaacaattcctttcattgatttgttattagtactcaagatttgagtggcagggtatatatccttccactcaaaaaaatgaatattttattaaataaatagattaccttccgagattaaaaaaacagttctaaaggtcaaacatgaagtgtccgacaacaaggtgttgagcagatgatcgtaatgttatgattagttgattttttcgcaataccacttgggaatatgtagcatgacgccgatagtagctaacgtaacaactacgtaatagctcttcttgtattgcgtgagtttgccttcaagtccggcaaacgggccacggatcacccgaactgcttgtccgggacgggcttctgctgttactgtatcgacataaagagttcctttataattaggatcgcatacggcacggaattccaacatctcacagtctggaatctcataacaccgccgtgtactccggtcacgaacaagcaaaaaaggtatagtacaatcttttaccctttctaatagttctttttccgtaaattctttctcgataaacagcagattgtgtacagctggagtcagtttccgatgctttttaccatcaagcgtctcatgctcaatatatcgcatcggaataaaataatttaccccttttttttccaaatatttccccaaatgttcttctttacaatagaaggtttgtacagcataccatgccttccttccctctgtttgtcgttctttgtccaaatcattcattatcacccattaccccttgttttttatttcatcacttacttaaaagacaaaagcgccctgactttcacaaatgaaatccatttatgaagcagtagcgcatctcttaaggatttagcctttttatcttatctccatataagaaccaaggttcatagagaaacggatacagtactaaaacgatgcaaaagtaatacaatttaataaaagaacatacttttacagcttttattttgcctgcaaagatgttaaactcctgcctgcttaaacaaaaattcctctaagtgtatcgcaatgaaacacttagaggaattacacatattacaacgatatttcttacttcttagcttcctgacggctttcaatgattaagactccttttttcaagcctttacccgtagcttcaagggttattttgcctggctgctctgtcgaagatacaatagcagtcatcataccactgaagactttcatcttcggacgctggaaagattccaaggaagctgcattaccattagctcctgcacggtaactaccctctcccttcactttgaaactgatttcatgtgaggcatccggacacaaattaccgtctctatctaccactcgcactgtcacaaaagatagatcttttccatccgccttgattacattacgatcagctaccaattcaatatgatccggtttaccggctgtatggagttctttttcagctacagctttcccgtcagcattataagccacgactttcaccgtgcctggctcatattttgtatccatccacattaggcggtaacggctctgacgtttcaagttcatgatggaaacagagtcagcactattatcaatggttacggaaaggtctttggtacgtttcccttggctctttccgttgatgaataattcggctgaaggatagttggtatatacaaagacaggagttatctctccctctcgtcctttccaattccagtgaggaagaatgtgaagtgtttcctgttctttattccagtgactacgatagagataataacggtctttgggcagccctgctaaatcgataattccaaatagtgaagaatgactgggccaatctgtataatagggagtcggttcacccagataatcgaatcctgtccaaacaaactctcctatgcaataaggtaagtcctcatgctgaataaaatcatcctcaggcagattggaccatgaacaagactccacatcataagaggaagactgatgatcgtcatatttcttcatccattgccgggtaacagggaatttatatactccacgcgaactaaccgtagaagcagtctcactacccaagactatctgttgaggaagttttttataattctcctgatatttatgtggcctataattaaatcccgcaatatccattactgccgccatattattattgactacagcatccggcgcatccatcccctgtgtgacaggacgtgtcggatcttcacgatgacaaagttcctgtagaaaataagacatcttaggtcctttatttccatcccattgttcgggaacctcatttccgatgcaccacatcaccacactcggattattacgataatgacgtagcaagttcgtcaaatcctttactgcccattcgtcaaaaacatgacgatagccgttcttaaccttcatagccttccattcatcaaacgattccgccatcaccatcattcccatctcatcacaagctctgattaactcaggagcaggcatattatgagaagtacgaatcgcattacaacccatatctttcaaaatacgaatctgacgacgaatagcagcatcattcacagcgcctcccaaggggccgagatcatgatgattgcatacgcctttgaatgaagttctctttccatttaagaaaaagcccttattgggaatgacctcaatagtacgaataccgaaagatgttgtatattcatccttcagtatattgccttcatagactttagagacagcctgataaagaacaggagtttccgggctccataaagccggacgactaacaacaagttcctggctgaagatattatcatcaaaacgggaaccttgtttttcatcagtagttactacttttccatccttatctttaagttcagtcactatacggtatgcatcaaactgttttccgaaaggtacgaccaaagtcgtttttatattcactttcgcataatcatccttcactaccggagtagttaactgtgtaccccatgtcggaatatgagcatcttccgttactaccagatgtacatttctgtaaagtccggctcccggataccaacgggaagattctgtctcattctccagacgaacagctaaagtattctttgtcccctctttcagatagggagttacatccagataaaaggtattgtatccataaggccaataaccagcctcctgaccgttaatatacacacgagcatggctcatagctccgtcaaaaattaatgtagcctttttccctttgacaaaagagggagcatcaaaattcagccgataccaacccactccgacgaaaggaagaccacctgtacgtccggcatgttccatcgcttctttttgtccgtcttgcgcaatggctgtcaattgcctgtcattatctataccaaaaggtccataaatagcccagtcatggggtactaccacagattgccacttgatatcattatagtcaggctgaataaaatcagcattatcttcacgtgtaaacttccaccctttctcaaaagtatacgaggttcgtacttgtgcactgatcacagagaaagaaaaaaggagggctattcctaataagtatctaatatttatagtcataaattatacatctgattatttcactactatttcatctgtaaatatccatccgccaaactcttctccggcacgagcctgataacgtatataccgtccttcagcactgccttcccatgaaatactaataaatttaatagcttcttttctatttacttcaaaagtatattgtttcaattctgtgaagtttgctccatcatcagaaatggaaatagtaacagattcaggcaaaaagacctctgcccctaccacttgcataaaatcagcagagacagaatggacagcagtttccgtacccatatcaatggtaacatccaatcgctttttatcgataaaaccttgccaggatccatctccataagtccagtcgccacgaataccatcagtaagagctgtatttccctgcgcaggatagtgaggactatacggagcattataaatcacctttttccccacagccaaatgacttatcggcttcaaagactccggacgacttcctatctcatttttaagatcaaaagtatgatatcctttcgcttgcaaatcatcaactgctttcaatgcacgattatgaaagtctgtccatgatttacgttcggaagccgaccaagccacttctgccaaagcaaggatacgaggatatatcatatattccatatgctccggagtggggatatattctgcccatagatttgcctgcacaccataaacaagttttgcctgttctacagttaaagaatctgaaaccggattatatgaataaaccttctccaatggcaaatatcctccgatggcttccggctgagaatacggagcatcctgataactatccaaataacaatattgaccgggagtcataattgcctgatgaccggaacggacagcagcaatacctccctcttcgccacgccatgacattacagtagcattaggagccagaccaccttgaagaatttcatcccaacccagcaacttacgtccatgtgcattcagaaacagttcaatacgatgaatcagatagctttgtagctcgtctacattagaaagatgttcatcctgcatccttttctgacatttcggacaagtcttccaagccgccttaccagcctcatcgcctcctacatgaatatattccgatggaaaaagctccattacttcagtaagcacattttctaagaaagtgaatgtttcttcatttccaacacaaaaatctgcgtttttataaggttcacccgaacaggagagttgcggataagcagccaatacttcttctgaatgagcaggcatctcgatttcaggaatgattgtgatataatgctgctgcgcatatgcaataatctccttcatgtcatcctgagtataataaccaccggaagcaccaggctcatcaaaacggagatatttccgtccgccattccaccacttcttccagttggcatcagtacgccaggcggcaaattccgtcaataaaggatatttctttatttcaagtctccatcctgccgcatccgtcaaatgcaaatgcaaacggtttagtttataaaatgccaatgcgtctatctgtttcttcacaaattctttagagaagaagtggcgggagacatccagcatcatcccacgataagcaaaacgaggggtatcctgtacttcaacagaaactatagaataacccgtgcccgaaggctgagataattgcaacagtgtctgaattccataaaacaacccagcaccggaagaagcctgaatcagaatatgttcaggagtaacggataatatataactttccggtgacaccaactgaggattcttttctgttatcaataaagacaagacattctgtttatctttctttttcccttccttaaattgtacaggtaatgcagttttcagatagtcgcccagaagaatagcttcttctccttgtaagtttgtataaagctttgttttttcagagagtaaaaaagagcccgtaccctgttccatctttaagggaacaggaattacggactgtgcattaatgggatgtgcacaaagacacatcccgattacccataagaaaagacaaactttagtgtatctctttcttatattcattaattaattgtgatttcgtctacaaataaaaagcctggataactcttaccaccatgccattccggaatacttttctcgggtgaagctataactttcacatattgtgcagttacaggtgtaaatgttagtttatggtcataaacaccatttttatcagtttccttcattgcaggataagcttcagatgccactttcgtgaagtttgtgccgtcttctgaaacttctacagagagtcctcttgtatcaaaaacccaatctcccttctctacgcaagtagaaatggcaacgcttgaaatctctgttggttgtttgagatcaatagtcacatccatatcatttcctctaaatgcaatccagcgtccggttttatagttaccatttcctttcaagccatctaccaacgtagagacacctttgaactcatattgtttattcaccggctgattagcaacaatcggcttcatgcttgatttactgaaatcgattttctcagaaacgacacgactatttccagtagggcgaatagctatagccgagaagtctgcattttccttaatcttcaaagcgccatcataaacgggagaagtactagtcggctctgtaccatctagcgtgtagtggattggcgcattgtcaattgtagtaagtgtaatgtctaaagtaccatcagccggattcggagtaaattctgcttttacgtcaaatacgtgctttgcataattatatccttctgcatcataccacttaatcagtcgtggaagacgagacaagaaatcttcgtagttcttcttatcaggtgttgaccactggacttcacacaaagcagcccaacgaggcaagaccatatattgagcatgagagaaagtagcaatatattctgtccagagattagcctgtacaccttttatatactgctgttcttccggagtaagggaagccggcatcggctcatagctgtacaccctttccatcggcaaataacctccgataccgaaaggttcattctcagtatctttagcctgataataatcaaaatacagataagtgttcggggtcatgatcacatcatgtttctgcttggcagcttcaatacctccactttcgccacgccatgacataactgttgcattaggagcaagtccgccttcgagaatctcatcccaaccgataatctgacgtccgtgatcgttcaggaacttctctatatgattgataacgaaactctgcaaacgttcttccttactatgattcttatccgatttcaagcccaacgctttgatacgtgcctgacatttcggacatttctcccatcttaccttcggacattcgtcaccacctacatggatatactctgaagggaagatttcaatcaattcgccatatacatcttccaggaatttcagaacctgatcgttgccggcacaaagtacatcatcggctactccccattgtctccaaacttcatacggtccaccggtacaacccaattccggataagcggcaagggcagccagcatgtgtcccggaaggtcaatctcaggaacaacagtgatataacgttctgcggcataatctacaatttccttagcctgttcctgtgtatagaatccaccatagggtgtattgtcatattcaccggagttacgtccgatgactgttcccgatctttgagaacctatttccgtcaacttcggatatttcttgatttccagacgccatccctgatcgtcagtgatatgccagtgcaaacggttcatgttgtgcaaagccagcatatcaatataagtcttcacttcatcaattgtgaagaaatgacgactaacatcgaaatgtgcaccacgataaccgaaacgaggagcatccttaatttcaacagcaggcaatgctacatcagcacccaaagcaataggcaatgatttacgcaaagtctgaataccatagaaaactccggcttctgtaggggcagttatcgtgacaccttgatcggtgactttcaactgataagattcagggttttctacttctgagcctaacgccagcactatagcatttttaccttcagttccggcttcaatcgaaaagtcttttccggttgcagtcttcagataatcagccaaaaattgcgcattacgctgcattttctcatttccttccggataaaggattttcacaccgcttttcaaaataaaggggtttacttgcgatgttacaatttcttgtggcaatgggataatctgataattggcttcttcttgtaccgagccacaagagctcatcagtcctgccagtgccacacatcctgttaattttaggagttgtttcataaaataaaaattaggtgttagtagttaataaattagttttatttataggtttctcgaatatgcttgatattgacaggtaattcttctcccttctttatccggggagaagtgataattactttcttacgttctccgggtaagagatcaaagaagttgtcactgtaacgggctccttgcaatggagtctcaataaaaatatcttttgccaacattgatgaaaagagagtcaattcacatttaccatccgtctgcttcatttgataggatactgatatcggaggaagttgcaaatctttcgtctttctgaaaaaatggacgctctcagccacctgatgtcccgatttatctttgagtatcaatttcaagaagctacgtcggcagtcttcgggagtcagccagccatccagttttgcacgataaacacattttgaagtatttgccggaacttccaacgaatgtacttgtatcttcttacccagcgtttttccatcaaaatccacgactttcatttccaatgtcatttgctccattgtatcaagccggtctgagatcagataaacactcaaactgtcattctgctgtataggattgatcaagaccggtgcaaaagcacgctttgcctgataatgtaatgccttccaattaccataataatcaatacttgaccaggatactaccggccaactgtcgttcaactgccaatacaatgtccccatacaataaggacgattgcgtctgtgagcttccagtccatgccgcatcccctgtccttgcaagactaatccgacatacacaaaatcctcgaaactttcgggaataatataatcacgttccatataagtacggatcaacgaattaccaatactactcttctgatgcgcattcatcacttcagactcaatctgataatcttcagaagcagcaaaagcagcaatggttttcatttccggaaatgactggaaaccaaattcactcataaaacgcggcaaatcagtatctaaagactcaaatggcttctttccgtaccagactccccaattatgactgtctcctgtcccccatgactccggacgcccccagttagcgagataaggcgaactgtgcacataaaaacgatccgaatcaaattctttaaccattgaaggcaacagctcacggaacagtttatcataaccatgcattaatccttgataaacctccggagtaaacttcttctcaaaaccccaatatttcagagcttccagtatttcattattaccacaccacatcgccaaagaggcatgattccgaagacggcgaatattgtaaacagcctccgcctctacccgtttcaggaaagtaggatcggatggataaggagtacacgcaaacataaaatcctgccagacaagtatcccgttctcatcggcaaggtcatagaaaagattattctcatatgtcccaccgccccatatacgaaccatattcatattggcctccttcatgtcacggaacaaagtctgatagcgttccgtagtaacattaggcagcagtgcatcctgaggaatataattagctcctttggcaaacatcggtatgccattgacttcaaaataaaaagattctccgtccttatctttttcatttaccacacgaatcgttcgtaaaccaatccgatgagattgttccgcaacaatccgatctccacaagctatctgagccgagaaatcatacagagtcggagttccccaaccatttggcatccatcgtacagggttcgtcacttcagcaggaagagtgatatgatttatcccgggttgcagggtcacctgctgttttacttctgtaacggtagttccattcaacgatacattgacccttacttcagccggaattttctgaggaacgatctggtttacaatcagttcattagacagacgagcgttttcatctgtcagcaataattgtctgacatggtagtcagatatggtagctatgtcgtaaaaacgaagagtaaccgggcgccagacaccacttgtcaccattcggatgccccagtcccaaccgtaactatacggagccttacggctgaacacactaagatgtttctcgtgatgatcgttatccaccggataattgaagccattggaagcatattgtggcaacgtttgccgaataggtgaatggaaataaatatataagtgattctcgcccttccgcaacacagattttacaggaagtgtataacccacaaacatattatcagccttcagcagtaatgagccgttgagatatacgtctgcataggtatcaagaccttcaaaaataagttggattccgtcacgattcaattgctcttcggagactataaaggaggttctatattcccagtcctcattctccacccattgaattttcttttcattcatcccataaaaaggattcggcagtaattcatgactgatcaggtcctgatgaaccgtaccaggaaccgtggctggcatccacttttcagtccctgattgagaaaattcccaaccggtatccagtagcatgacttccgaagtgtcattaccttgagcataaaccatactacagcaacatagcaatccacatgctatcggcgctatctttcctgtcaaatttaagatcatagtgggggcattagatattaacggagtaaagatattgcttttttgttaaatatttcctattgaagctacaaaatatctcatttcatcgaaaattcggcacgaaatgtcgaagcaggcagtccttcccgattgatcagattagcccgcgtaaaaggttgccagccataacgtacatagcggggatttggcacttctttactatacaccttcacctggtctcctacaacctcagccgttgccggataatagataccatcatattccgctacttcaaagcattgtaaaggctttccgtctgaactccgcatcccttttccataatcaaaagataaaaagactttcccaccgcgaacgtttgcaccacgaaataaaggaccggaaggaatgacatttttctgatacgttttattcaaagcccatcgcgccaaacgctctcccacgggtttcttacaggtaggatgcacatccagagaatcaccatgatcgctggatacagccattccgatatgagaaatttcattcaacattctacgctgactctcacggaaccaaggccaggaagggcgattcaaactggataattgtacataataaaaaggcaggcaggcatcattccaattcttccgccaactattcacgagcagtttaaataatttttcatgagcttcccaattatgtgcattcgattctccctgataccagattactcctcgtatcggatactgttccaaaggccgaatccccgactcatataaataacaaggctcatatggatgcctctgctggctatttgctgacttttttatattcaaagcagcccgtccgcgcacccattcctgaataaaatcatttttagtccagtcttttaaaatggcgggaaactgatattccaaactagctctatctacccaggcttctgtaggtgatcctccaacagcattgcaaatcaatccaaccggaacattcagactatctcttagcatcttaccaaaatagtatgcaattgccgagaaatcagaagctgtcgccggagtacaatttttccattccgtatccttataatattggagatgattcaacgaatcaagtacgttcgcctcccattcgacggcatttgtgcgccaacgtgctttcatatcatacaaacgaagttgctgatctacggcacgtggaatatcggctcgggcagtcgaagcctgtttcagcataaactccatatttgactgaccggaacaaagccagacttcacccgctaacacattttgatattgaaaacccgtctcatccgttgagatctttaaggtataaggaccacccgcctttaaaggaggcagcgttaccgaccattttccattcagacctgcttttgttttcatttgccggtcggctatgcttacagtaacccggtccccggcattggcaattccttgaaccgtcagcggaacatcccgttgcaataccatattgtctgtataaagcaacgacattttcagtccgccataatctccggtaatggcggaatatacggtctgagccataataaacgctccttcgggatcagggtgtacggcgtccgtcaatatgaaagggtatggatacaacggctcatgaaagtcgatcaactgtactccggtatagcgtgccacattctcaatagccaattgtatttctccatgccagtcacgtgtccctgacaggaaacgaggatgccgatcggcaataggcgtaagtctggcaatcataatccggactttagaattagccgcccgaaaagaatcgatcaattcaatgtaatctttcacaaagaaatcacgataatcggaccaatcacggggatctgtatcattgatgcccaaatgaataaccacaatatctccgccaaagtcgatcgctctgcgatactcatcttgctgcatataaggccggtgccctttattcaacaaggtagcacccgatttgccgaagttttcgacttgataagactctcccaacatcttctgtaattgcaccggatacgattgtgtagtccggtcgggcaatccataaccataggtgatactattcccgatgcaggcaactttaatacgattttcctgtgcactcgctgctgtaataaacaagatggaaacaacaatcaataatacatttttcatcatataaaagtcaattacattttcttttccggagaatagatcagcccttctacggccttatcgccgtcaggagtcacaaatactgcagtaaacatccatttaaccaatcgtacttcattcgttgagaatttgccgacaggcagtttcagcaataccttattccagcctttatgcaaatgaacccgtagtggcggacgtgccacacaattctcattacctaaggctgtttccgagcttttcacgagatgagtagcagaccataccgggggcagtatttcctgatcattaatccaaatacggctttctttataatcccactttcccggcaatggcggcaggtcattctctgaacgtccataattctgaaattcagcccataagcctacttcctgtgttttagaagaatagacatacgtgtaagcataagcagtatgattctcctgtggatctttgtaaaaagccggcacaatcttaccccatacgtgccgaagatagataccggctcctatggcaggacgcactccatattgcttcccttcataggtatatgaatctttcagctcttcttccggtggaaaaactttagtcagatccccctcatttggaaaagcatctgtaatgttccattttacatgagtctgtttgacataggcaaatggataccctttaaacagatgctctttataccataacatacgactttcgaagtcctcaaaattacgaaagacctcagagttttcatctacaggaagaattgttccctgcttatcgaaatattcagttcctcctccccgccatgaacgctctgcgatagccagcatattcgggtaaaagttattttccagaaccatattccactctttgtcgattaaacgatcgttccagatacccataatgactccggcaagatcatcacttcccatatctgcattataaatccgactattatatagagcaattatatcgccgaacgtatcaaaatgattcaaataatggaaacgggagtcaatagcgggaataccctgttgggctttgccacgataactccaaagttgcatcatgtcgatctcacccgccttatacttccatccgggattccaggaaatcacttttttccctttgtcacggacataagccaccatttcgggcacaaactgcggattagtaaaatgcacttcgtctgttccaatatggagatatggaacatcaaacgtttcacaaatctcatccagcaggagtttcaggattttcattccttccggactttgcatatcatgacggaaagtacggataaatgccgcactatgcccgggcatatcaatctccggaatcaacagtacctgatgagctttacagaactcggtcaactctctggcttcctccaacgtgtaatacttacccgccatacgagtcatattcgtactgtcattcagcatcggaaagattttactctccagacgccatgcctgattttccgtcaagtgccaatgaaaggtattgattttaaatcgggataatatggctatctcacgtttcaattcttccaaagacaagtagctacgccctacatcctgcatgaaaccccgaatccggaaagccggccaatcagtgatagtagcacattgcaggcggatcttctttcccttttcttcttttagttgatatagcgtctgcatcgcccaatatactccgcgctctgctacagcctccacagtaattgcctttggagtaatagtcagacgataagcctcttccttattgacagatacattgtcaatcgcgtcaaccaattttatattgatagaggatgccgactgatcagtcagagtacctcccatctccgtcacaaactgtttccattcctgcgaaagcacaggagtggaaagctgcattttacccacgataaaatatccttttgcaagcacacattgctgaggttggggaagcagacgcaaatgatctgcccccaatatatataaggtatggaataaaaatgcaatccccaaaaagattcgaagacttttcatcgaatcaaatctttcagttttacagcttgaaatgtcatgtgggctgcactactctcatacaagataccaatcgtttcccgatcaatcattgtcagacagctatatccccagccttctccttcatccagcattaactgatgttcgggaagccaggtcagcccatcgtccaggctagctttaatagttatatgattgcgtcctctggtcgtattcggattcgagaacaaaagaatatctttatcaagtacattatcttcagcttccacatggatcaaactagccatacatacaggttcctgcaaggccttccgagaggaaggatgttctgtccatgtcttgcccagatcttttgtaattgccacagcacggcttcctccacggttatcccgcatattcagcatcagcactccgggctctgtttctactacttgcgcttcggttgtattggtgcgtgccatgttgtgcatcttccatgtttttccgcggtctttactatacatgataccggcattaggtacacgggtagagtcgataaactgagtagggaatactaaagttccatcactcattgttattccccgtcccggtccctgaagcaagaaataccaggaagggtcttttacttgttcggttatattaatcggtttcgaccaggttttaccgtcatccgtactttttgccatcaccagttgtgccgtttgatatagatccattccgggatgagaactccaccaggcacgttgattacccattccgtgtgtccatgcggcaacaacccaaattgtattcgtttgggtatctaccaaaatagaagggtcccctactccattctgtgcagcaggcaaaccatcgtattcaccgaacgaaagaggaaggcgcatcttttcccatgttttgccaccatccgtgctccggctcaaaccgacatctacatattcctgcagatcgacactgctattataacggacatcatatacgccaagcagcgttcctttatttgaagttaccaatccgggaatacggaaagaagccgaaccgtcatcaccggcatggcggacgcccactgccattcgatgaatgatgtctttcggcgaccgttcttcacaaatggcttctttaccatcgatcttcactgattgaagttcagaacttattttcgtgaatagagaagtctccggcttcatctgcaagctgatccaaaagaaattaatccccgggaacaacttataatgactcttcaaaactacttttgcagaaggctgcaaggcttccgcacattttatcgaataagacggtattgctgccaatgtattccccggacggtgactggatatatagtcaacaggtgcaaacctcttctttcctttatcttgtaaagcttccgtaccgccataatagagtttgactgcctgtacatccgacagattgacactctttccaaaatccaaaacgatctcatccatcatccggctttcttttgcatctaaacgaaagtagaacaatacgttatcctgccgctcaattaaaataggaatttgcgtctgatgtacaaaaacggtgtctgaagctttcacaaagatagagcaccctaacaagagaataagggtaaataaataatgatttcttttcataaatgggggtattagttaatttaacgaaggcaaagataagattttctctgcatatatttaacagtcaaagcgacaaacttgcgttttttaccaagttctcgtaggactagtcaacactctgaccaccgttcttgctcttgtgatctgtaaaggtggtaacatcaaagccgagcattactaattgcccgttcactttctttcggacggtgcggatcgcgatatatacgtttagcgagcgtatcagtaagttcattcatttgactctgatatcttacttaagttttacttttcatcatgtcataaccttattgaatttattcaggtggttatagcacgagggttccacctcttcccattccgaacagagaagttaagcctcgtcacgccgatggtactgcgtaacagtgggagagtaggtagccgccgtttttagagaagcccttcaggtagaaataccagaagggctttattgttttttgtccttctgaaatttgtgacatcatttttaacagcaataatcctcataatacctattaaaaaagtgaatatttactggtaatttgtatgttatgaggatatttatttgtatctttgtcgcccgaattgtaatctaacgatttaaaaaagagagaagctttgggaaagtttgataaatacaaaattgatttgaaaggcatgcaaacagactctgctaagtatgagtttgttttggataacctttacttcgcccacattgatggtcctgaagttcagaaaggaaaagtaaatgttactttgactgtgaaaagaacctctcgtgctttcgaactgagctttcagacagacggtatagtatgggtaccatgcgaccgttgcctggacgaaatggagctacagatcacttcgtctgacaaactgatggtgaagtttggacatgaatatgcagaggaaggcgacaacctgattgtgatccctgaagaagagggagaaatcaatgttgcatggttcatgtatgaattcgttgcactctctatcccaatgaagcatgtacacgctccgggtaagtgcaacaaagctgttactagcaagttgagcaagcatctcaaaacagatgctaatgaagatagcgatgaagtcttcgacacaggtggagatgatatcgtagttgcggaggaaatggaggaacaaattgatccccgttggaatgaattaaaaaaaatattagataataattaaagttttaagaaaatggcacatcctaagagaagacaatcaaaaacaagaacagcaaagagaagaactcatgataaggcagtagctcctacattggctatttgtccgaattgcggagaatggcatgtttatcacactgtatgtggcgcatgtggttactacagaggtaagctcgctatcgaaaaagaagcagctgtataattagtacagtatactcaagacagccgagggggaaaactctccggctgctttaagtattatagtatcgctaatttaaaataggtttgatggaaaaaataaatgcagtaatcacaggagttggaggatatgtacccgattatatcttgactaatgaagagatatcaaaaatggtagataccaacgatgaatggattatgactcgtattggagtaaaggaaagacatattctgaatgaggaaggattaggtagctcatacatggcacgcaaagctgccaagcagttgatgaagaagactggagccaatcctgacgatatcgatttggttattgttgctactactactcctgactatcacttcccttctacagcttctattctttgcgataaactcggactgaaaaacgcatttgctttcgatttgcaggccgcttgttgcggtttcctgtatttgatggaaacagctgctaatttcattcgttcgggaagatataagaaaattatcattgtcggtgccgataagatgtcgtcaatggttaactatacagatcgtgctacatgccctatctttggtgacggcgccgctgcttttatgatggagcccactacggaagatttaggtgttatggattcgatactgagaactgatggtaaaggcttgcctttcctccatatgaaagctggtggttcggtttgtcctccgtcttatttcactgtagacaataaaatgcactatctgcaccaggaaggaagaacagtgttcaaatacgcggtttcaagtatgtcggatgtatcggctgcaattgcagaaaagaatggtctgaccaaagatactattaactgggtggttccccaccaggcaaatgtacgtatcattgaagctgtggctcatcgcatggaactcccgatggataaagtgctggtgaacattgaacattatggtaacacaagtgccgctacgcttcctctgtgtatctgggattttgaagataaactaaagaaaggtgataacattatatttacagcattcggcgccggatttacatggggtgcggtttatgtaaaatggggttatgacggaaaaaaggaatcgtaacgtaagttactgaattataacacaaaaaacgcatcctatttcgattcgatgcgtttttttgtctcaaccaataaaataaagagaaatgcataaagcaggttttgtaaacatcgtagggaatccgaatgtcggaaagtcgacattgatgaatgctttggtgggagaacgtatatcaattgctaccttcaaagcgcagactacccgtcaccgaattatgggaatttataatacggatgatatgcagattgttttttctgacactccgggagtattgaaacctaactataagttgcaggagtcgatgctgaacttctcaacttctgcactgacagatgcggatgtactgctttatgtgactgacgtggtggagacgcccgataagaataatgagtttatgggaaaggtgcgtcagatgacggttcctgtcctgttgcttatcaacaaaatagaccttacggatcaggagaagctgatcaaactggtcgaagagtggaaggaactgcttccgcaggctgagattattcctatttctgccgcatctaagtttaatgtagactatgtgatgaagcgtattcaggaactgttgcctgattctcctccttatttcggcaaagatcagtggacggataagcctgcccgcttctttgtgaatgagattatccgtgaaaagattctgctatattatgataaggaaatcccctattcggtggaagtagtagtggaagaatttaaagaggaagcgaaaaaaatacatatccgggcagtgatttatgtggaacgtgattcacaaaaaggaatcattatcggcaagcagggaaaagcattgaaaaaagtagctaccgaagcacgccgggaattggaacgtttctttggaaagacgattttcctggaaacttatgtgaaggttgataaagattggcgtagttcggataaggaactgcggaactttggttatcagttagattaagagtattcatgcgactgggatagtcgtgaaaaaacaaggtattgagctatgaataatttagttgcaattgtaggacgccctaatgtgggcaagtctaccttatttaaccgtctgacgaaaactcgtcaggcaattgtgaatgaagaagcgggtacaacccgtgacagacagtatggcaagtccgaatggctgggccgtgagttctccgtggtagataccggcggatgggtagtgaactctgacgatatctttgaagaggaaatccggaagcaagtattgctggctgtggaggaagcagacgttattctgtttgtagtggatgtgatgaacggagtgactgacctggatatgcaggttgcgactatcttgcgacgtgctaacagcccggtgattatggttgccaataagacagataataatgaattacaatataacgctcctgagttttataaattaggattgggcgatccgtattgtatctctgctatcaccggaagtggtacaggtgatttgatggacttgatcgtcagcaaattcaataaagagacttcggaaattctggatgatgatattccccgctttgctgtggtaggacgcccgaatgcgggaaaatcctctatcgtaaacgcgtttatcggagaagaccgtaacattgtaacggagatcgccggaacaacccgtgactctatttatactcgttacaataaattcggatttgatttttatctggtagatacagccggtatccgtaaaaagaataaggtgaacgaggatctggaatactattcggtagtccgttcgattcgttcgattgaaaatgcggatgtctgtattttgatgctcgatgctacaagaggcgttgaaagtcaggatttgaatattctttctttgattcagaaaaatcagaagggactggtagtcgtgattaataagtgggacctgatagaggataaaacagcgaaaatgatgaaggagtttgaagcgactatccgttcacgttttgctccctttgtggatttcccgattatatttgcttctgcattgaccaaacagcgtatcctgaaagtgcttgaagaagcccgcaacgtgtatgaaaaccgtacgacgaagataccgactgcccgtctgaacgaagagatgcttccgctgattgaggcatatccgcctccatccaataaaggtaaatatatcaagattaaatatatcacgcagttgccgaatacacaagtgccttcatttgtgtacttcgccaatttgccgcagtatgtgaaggaaccgtacaaacgtttcctggaaaacaaaatgcgtgagaagtggaacctgaccggtacaccgatcaatatttatatccgacagaagtaaaaggtatattcgtatgaataaaaagaaatcgcccggcaatattccattgccgggcgatttctttttatttaagaggattattcgtctttatttaactggaagtccttacggcgcaaaacgaaactgttactcaggtatttttcacgcacaatcttgttttctgccaattcttccggtgttccctgaaacaggatcttgccttcgaacagcagataagcgcggtcagtgatacttaatgtttcctgcacattgtggtcggtaatcaggataccgatgtttttatccttcagcttccacacaatctgctgaatatcttctactgcgatagggtcgactccggcaaacggttcatcgagcataatgaacttcgggtcgatggcaagacaacgggcgatttcagtacgacggcgttcacctccggacaactggttacccttgttcttgcgtaccttctgaaggcggaactcggcaatcagactttcgagcttgtctttttgataatctttgggcttattggtcatttcgagtacggaagcgatattgtcttctacactcatctgacggaatacggaggcttcctgtgcaaggtatccgatacctgtctgcgcccgtttgtatactggaaacttggttatctcaaggtcgtcgagaaagattcgtccttcattaggagtaatcagtcctacggtcatatagaatgaagtcgtcttaccggcaccgttcggtcccagcaaacccacaatttcaccttgcttcacgtcgatggatacatggcttacaacggttcgtttaccgtactttttaaccaggtcttccgtgcgaagcaccatcttgctttcttccatattctagttattttgcggcaaatgtagtaaaaataagctgaaataatgtacatttgcagacaaatagtgtgagttatgataaaagcattgagaactgtcggacgatatatcatactgatgggacgtactttttcccgtcccgagcgtatgcgtatgtttttccggcaataccttaacgagatggagcaactgggtgtgaactccatcggcatcgtgttgttgatttcgtttttcatcggcgcggtgattactattcagattaaattgaatattgaaagtccatggatgcctcgctggacagtgggatatgtgacacgtgaaattatgttgctggagttctcctcttctattatgtgtttgattctggcgggaaaggtcggctcgaacattgcttcggaactgggaacaatgcgggtgacgcagcagattgacgcactcgaaataatgggtattaattccgccaattatctgatactacccaaaataacggccatggtaactgtgatccctgtgttggtgacgtttagtatttttgccggtattatcggtgctttttgtacctgttggtttgccggtgtgatgaatgcggtcgatctggaatatggactgcagtatatgtttgtcgaatggtttatctgggcgggtatcataaaatcccttttctttgcctttattattgcaagtgtttctgcctttttcggctatacggtagatggtggttccattgctgtaggaaaggcttctacggatgctgtggtaagcagtagtgtgttgattctgtttgcagatttggtattaactaaacttttgatgggatgattgatattagaggactttataaatcatttgaagataaaacggtattgagtaatatcaatgcgtcttttgagaatggaaagacaaacctgattatcggtcagagcggctctggtaaaacggtcttgatgaaatgtatcgtaggcttgcttactcccgaaaaaggagaagtgctgtatgacggacgtaaccttgtcttgatggggaagaaggagaaaaagatgcttcgcaaggagatggggatgattttccagagtgcggcgctttttgactccatgtcggtgctggataatgtaatgttcccgctgaatatgtttagcaacgatacactgcgtgaccgtaccaagcgtgccatgttctgtctggaacgtgtgaatctgactgaggcgaaagataaatttccgggtgaaatcagtggcggtatgcagaagcgtgtggctattgcccgtgctatcgcattgaatccgcagtacctgttctgtgatgaaccgaactccgggctggaccccaaaacgtcattagttattgatgacctgattcatgacatcactcaggagtataatatgacgactattatcaatacccatgacatgaactctgtgctgggaatcggtgagaaagtgatttatatttatgaaggacataaggaatgggaagggacgaaagatgatattttcacttctaccaatgaacggctgaataactttatctttgcttcggacctgcttcgtaaagtgaaggatatggaagtgcagaatatggaaggctgacggaaaagtaaatagaaggacataaaaaaacttctgtcatcaggtggcagaagtttcttttttttcttagctatattagcgtcggcaattaagctctgggtctagcttctttaactaccattgtacggcccatgtactctgcaccgttcaattctgcgattgctttagcagctgctgcatcgtcttccatttcgatgaaagcaaatcctttggatttaccggtttcacgatccataactactttaactgatgatactgctccgtaatcttccatcacttgttgcagatctccttccttaacacggtagttaaggtttccaacataaatgttcataatgaaaatgataaaaaaataaataaatgaataaaactctctggatagatggttactaataaaaagattaaaacgacagagagtttacaaatgcgttttcgaaacagaagtaaaaaccttgtaatcaaatcgagaaactaatggtccatcaatccgcagcaaagaaaagaataatttttggattgaccatctttttcttacttttatttgcaggtaacgagaaaaaaacaaggatgcgtggctagtgaaccgctgcctgtcatgcaattgtcatttgtatattccaaaatagatgcgaaataaatctgcaatgtcttttgaaaattgaaagattagcactaattttgcaccctcgtttgagttagaacaaagtataaatcaaataaataattgtcagaatgaacgtttcattacaaaacattgacaaagtaagcgcacagcttactgtgaagcttgagaaagccgactatcaggaaaaagtagacaaatcgttgaaatcattccgtcagaaggcacaaatgccgggattccgtaaaggaatggttccgatgagcctggttaagaagatgtatggtaaatcagtgattgcagaagaagtgaataaggtactgcaagaagctgtttacaactatattaaagaaaataaggtgaacatgctgggcgaaccgttgcctaacgaagaaaaacagcaggttatcgacttcgatacaatggaagaattcgagtttgtgttcgatatcgctctggcacctgaattcaaagctgaagtaagcgctaaagataaagtagattactatacgatcgaagtatcggatgaaatgatcgaaaaccaggtgaagatgtatactcagcgcaccggtaaatacgacaaagtagacgtttacgaagataacgacatgctgaaaggtctgttggctcagctggacgaagaaggtaatacgaaagaaggcggtattcaggtagaaggtgctgtattaatgccttcttatatgaagaacgacgatcagaaagctatctttgctaatgcaaaagtaaatgacgtattggtattcaacccgaatgttgcttacgacggacacgctgctgaactcggctctctgttgaagatcgacaaggaaatcgctaaggatgtgaagtctgacttcagcttccaggtagaagaaattactcgtttcgtaccgggtgaactgactcaggaagtatttgaccaggcatttggtgaaggtgtagtgaagactgaagaagaattccgcgctaagatcaaagaagaaatcgcagcaagatttgttgctgacagcgattataaattcctgatcgacattcgtaaagtgatgatggacaaagtaggtaagctggaattctctgatgcattgctgaaacgtatcatgttgctgaacaacgaagaaaaaggcgaagaatatgtagccgaaaactacgataagagcattgaagaactgacttggcacctgatcaaggaacagctggtagaggcaaacgatattaaggtagagcaggaagatgtgctgaagatggcgaaagaaactaccaaagcacagttcgctcaatacggaatgttgtctgtacccgaagatgtgcttgataactatgcacaggaaatgttgaagaagaaagatactatcaacaacctggtaagccgcgtagtggaagtgaagctggctgcagctttgaaagctcaggtaactttggagaacaagaacgtttctatggaagaattcaataaaatgtttgaataatcgttcggttgaatagaacataaagtcacagaaacacagagtttttataaaattataactctgtgtttttttgtgtctctgtgttctttttcgtttctttgcacttacgtttattataaatttaattagaaaggaacaataacatggatgattttagaaaatacgcaaccaagcatttaggaatgaatggcatggtgctggacgatgtgattaaatcgcaagccgggtatttgaatccctatattctcgaagagagacagctgaatgtaactcagctcgatgtattctcccgactgatgatggatcgcattatttttctgggtacacaagtagatgactatacggcaaacacgcttcaggcgcagctgctctatctggactctgtagacccgggcaaggatatctctatctatatcaattctccgggcggtagtgtgtatgccggactgggtatttacgataccatgcagtttatttcaagtgatgttgctactatctgtacaggtatggctgcttcgatggctgccgtattgctggtagccggtgccgaaggcaaacgctctgcattgccgcattcacgcgtgatgattcaccaaccgatgggcggtgcgcagggacaggcttcggatattgaaatcacagcccgtgaaattcagaaattgaagaaagaactttatacgatcatcgccgatcattcgcacactgactttgataaggtatgggccgattcggaccgtgattactggatgacagctcaggaagcgaaagaatacggaatgattgatgaagtattgattaaaaaataaaaatggctgattcaaagacaaagaaaaagtgtagcttctgtggtcggtcggagaatgaagtaggattcctgatcacaggaatgaacggctatatctgcgacagctgcgctactcaggcttatgagattactcaggaagccctgggcgaaggcagaaaaagggcgggagctaccaaactcaacttaaaagaactgcccaaaccggtagaaataaagaaattcctcgaccagtacgtaatcggacaggacgatgcgaaacgctttctttctgtatcagtttacaaccattacaagcgtcttttgcagaaagacagcggtgatgatgtggaaattgaaaaatcaaacattatcatggtgggtagtaccggaaccggaaaaacattgctggcacgtactattgccaagttgcttcatgtcccgtttacgattgtagacgctacggtattgacggaagccggttatgtcggtgaagatattgaaagtattctgacccgtttgcttcaggtggcagattataatgtgccggaggctgagcaaggaattgtgtttatcgatgagatagacaagattgcccgcaaaggagacaatccttctatcacccgcgacgtaagtggagagggtgtgcagcaaggtttgctgaaattgcttgagggatcggtggtgaacgttcctccccagggaggccgtaagcatcccgaccagaaaatgattccggtgaataccaagaatattctctttatctgtggtggtgctttcgatggtattgaaaagaaaatcgcccaacggctgaatacgcatgtggtaggatataccgcatcgcagaaaacagcagtgatcgataagaataatatgatgcagtacattgctcctcaggatttgaagtcattcggcctgattcccgaaataatcggtcgtcttccggtgctgacttatctgaatccgctggaccgcaatgcactccgtgctattcttaccgagccgaaaaactctatcatcaagcaatatatcaagttgtttgaaatggatggtatcaagctgacatttgaagattctgttttcgaatatatcgttgacaaggctgtagaatataagttaggtgcccgtggattgcgttctattgtggaaacaatcatgatggatgtcatgtttgaaatcccttcagagagcaaaaaagagtataaggtaacgctggattatgcaaaacaacagctggaaaaagcgaatatggcaaggctgcaaattgcttaatatcaaatagtaaggctactgaaaatgattgtttctgttttttcttgaaaatattagtcgtattttgcttggtaattacgaagttgtttataactttgtttggctctcttgcaatggagggctttacttaaagttaaaccatgaactgaataaaacaacctaagttaagatggcagggaagattaatttaacagatgaactgaaaaagtatttcggatttaataagttcaagggaaaccaggaagcaatcattcagaacttgcttgatggtaaagatacctttgtgctaatgcctaccggtggcggaaaatctttatgctatcagttaccttcgctcttgatggaaggtacggcaattgttatttctccgctcattgcgttgatgaagaatcaggtggatgcaatgcgtaatttcagtgaagaggatggcatcgcccattttataaattcttcattaaataaaggcgcaatagaccaagtaaggtctgacatccttgccggaaaaacaaaattgctatatgtggctcctgagtcattgacaaaggaagaaaacgtagattttttgcgttcggtgaaaatttcgttctatgcggtagacgaagctcattgtatttccgaatgggggcatgacttccgtccggagtatcggcgaattcgtccgatcattaacgaaatagggaaagctcccttgattgcgcttactgcaacagcaacaccgaaggtacagcacgatatccagaaaaatctggggatggtggatgcacaggttttcaaatcctcgttcaaccgtccgaatctttattatgaggtacgcgcaaagaccaataatattgataaagatattatcaagttcatcaagaacaattcggaaaagtcgggcattatctattgcctgagccggaagaaagtagaggaacttgctgaaattcttcaggcaaacggaataaacgcgcgtccttatcatgcaggtatggactcaatgacgagaacgaaaaaccaggatgatttcctgatggaaaaggtggaagtgattgtggctaccatcgcttttggtatgggaattgacaagccggatgtacggtttgtgatccattatgatatcccgaagagtctggaagggtattatcaggagacaggacgtgccggcagagacggcggcgaaggccagtgcctgaccttttatacaaacaaagacttgcagaaactggaaaagttcatgcaaggaaaacctgtggcagaacaggaaattggcaagcagcttctgttggaaaccgctgcttatgccgaatcttccgtgtgtcggcgtaagacattgctgcactatttcggtgaagaatatacggaagaaaattgtggaaattgtgacaactgtttaaaccctaaaaaacaagtggaggctcaagagttattatgtgccgtgattgaagcgattatcgcggtgaaagaaaattttaaggcagattatatcatagacatactacaaggtagagaaacgtcggaagtacaggctcacctacacgaagatctcgaagtgttcggttcgggtatgggagaagaagacaaaacatggaatgcagtgatccgacaagctttgattggcggttacttgagcaaagatgtggagaattatggtctcctgaaagtgacggaagaagggcataagttcctgaagaagccaaaatcgttcaagattactgaagataatgattttgaagaaacggaagaagaagtacctgcacgtggcggtggctcttgtgcggtagacccggctctttattcaatgctgaaggacctacggaagaagctgtccaagaaactggaagttcctccttatgtcattttccaggatccgtctttggaagcgatggctaccatctatccggtgacattggatgaactgcagaatattccgggcgtaggtgccggaaaggcgaaacgctatggtgaagagttctgtaagctgatcaaacgtcattgcgaagagaatgaaatcgaacgtccggaagatttacgtgtacgtacggttgccaataaatcaaagatgaaagtggctattattcaggctatcgaccgtaaagtggcgctggacgatatcgctctttccaaaggaatcgagtttggtgaactgctggatgaagtggaagcaatcgtttactccggaactaaactgaatatcgactacttcctggaagaaattatggatgaagatcatatgctcgatatctatgattacttcaaggaatctacgacagacaagattgatgatgctcttgacgaactgggcgatgaatttaccgaagaggaagtccgactggtgagaatcaagttcatctctgaaatggctaattaaaaaagcgaaaaaaataggcgtgcaggtatgctgttttgaataaaaaccgtatatttgcacgcaataaatttttaaacgcacagccctatgtcatttattgctgataagattgtaatggatgggttaacttacgatgacgtattgttgatccccgcttattctgaagttttaccgcgcactgtcgatctctcgacaaagttttcaagaaacattgagttaaaaattccttttgtgacggctgccatggatacggttaccgaagcgaaaatggctattgccattgcccgtgaaggtggtatcggtgtgattcacaaaaatatgtctattgaggagcaggcaagacaagttgccattgtaaagcgtgctgaaaatggtatgatttacgatcctgttactatcaagagaggttctactgtcagcgacgctttgggaattatggctgaatataaaatcggtggtattcctgtagtggatgatgaaggttatctggtaggtatcgttactaacagagatttgcgtttcgaaagagacatgacaaagcatattgatcttgttatgactcctaaagaaagattggttactactaatcagtctaccgatctggaatctgctgcacagattcttcaaaaacataagattgaaaagttgccgattgtaggaatggatggcaaactgatcggtcttgttacatataaagatattacaaaggcaaaagataagccgatggcttgtaaagatgccaaaggtcgtctgcgggtagctgcaggtgtcggcgttactgctgatacgctggatcgtatgcaggcattggtggatgccggtgcagatgctatcgtaatcgatacggctcacggacattctatgtacgttattgaaaaactaaaagaagcaaagaaacgcttcccgaatattgatatcgtggtaggtaacattgctaccggagaagctgcgaaggctttggcagaagctggtgctgatgcagtgaaagtaggtatcggtccgggttctatctgtacgactcgtgttgttgcaggtgtaggtgttcctcagttgtcggctgtatatgatgtagccaaggcactgaaaggtacaggtgttcctctgattgctgatggtggtttgcgctattccggtgatgtggtaaaagcattggctgccggcggatattgtgtgatgatcggatcattggttgccggaacagaagagtctccgggtgatactatcatctttaacggacgtaaattcaaatcatatcgcggtatgggttcattggaagcaatggagaatggctctaaagaccgttatttccagagcggaactgccgatgtgaagaaattggttccggaaggtattgctgctcgtgttccttataaaggtacactttacgaagtagtttatcagttgtccggtggtcttcgtgcaggtatgggatattgcggtgctgctaatattgaaaaacttcatgatgcgaagtttactcgtattacaaatgccggagtgatggaaagtcacccgcatgacgtgacgattaccagtgaatcgcctaactatagccgtccggaataatttatataaacggtaaacgattagcggtgaacggtgaacaggctgtatggcatatgttcgttgttcaccgtttgtcgtttttaaataaaaatcaatgatgaaaagaaatctgcttttaggatggataagtctcttcggagtattagctttcgctcaggaagatcccgtagtgatgcggattaatgggaaagacatacctcgttcggagtttgaatactcctatcgccggcatgcggacggtaatggtatgaaattgtctcctaaagaatatgcggagtttttcattcagtctaagttgaaagtggaagcagccagagcggccggactcgacacaacttcggcttttcgcaagcaacaggaggcttatcggacaaatttgctgagatcatacctgctggatgatcaggaaatggatggcaatgcccgtattctatatcagaagatgaaggaaaatgtacgtggcggacaagtgcagatacagcaaatttacaaatatctgcctcagaccattacatcccggcatttacaggaggaacaggctcgcatggactctatttatcaggtgatacaaaatcagccgggtgtggattttgcccgtttggtggatcggttttcggatgataaacgttgtcggtggatagaaagtttgcagacaacctcggagtttgaggaagcagctttctctttagcaaaaggtgaaatatccaaacctttttttactccggaagggattcatattctgaaagtcatagatcgaaaagaagtgcctgcatatgaagtcgttagtgacagccttctaaatcgtttaaggcgtcagccgttggataaaggaacggaagccatcgtagaacaactgaaaaaggaataccagtatattccgaatatggagtctttggaggaagtattgcagaaaggtggaacggagcggactttgtttaccatcgacgggcaggcatatacaggggaaatgtttaagcggtttgctgcatcccatcctcaggctgtaaaacgacagttgaatggctttatagcaaaatctctgttggattatgagagtcagcatatggaaagaaagcatccggaacttcgttatactttgcaggaatatgcagagaaatgtttggctgaggaaatcgtgcatcagaaagtagatttaccggctgttaacgaccgggtgggattggctacgtattttaagtttcattcatcggattaccgatgggagcatccccgatacaaaggagtagtgttgcattgtgcagataaaaagactgctaaacaggctaaaaagctactgaaaaaagttccggagaatgaatgggaggatatgcttcgcaaaacatttaatacatccggtgctgaaataattaaaattgaacagggtgtttttgccgacggagataataaatatatagataaattggtctttaagaagggcgcttttgatcctgtagtgtcttatccttttactattgctgtaggcaaaaaacagaagggaccggaggattacagagaggtaattgatcaggtgagaaaagattatagaaactatcttaacgcatattgggagcgggaattgagggagtccggtaaggttgaaataaaccaagaggttttaaaaacagttaataataactgatgtaaccgattattcactatcttcgtaccttaaataagtagatttgaattgacaatgcgaatattagtcctcttactaattacccttctctgttgtggagcgtgcaaagagcagtacgaccacaaaggcaagactgcattggtggaggtagatggtaactttttgtataaagaagatttgatgtctgtactaccggtcggattgtcaaaagatgatagtattcttttcgctgagcattacattcgtagttgggcggaagagattttgttgtatgaaaaagcagcgaataatattccggataatgtggatgtagataagctggtggagaattacaggaaagctttgattatgcatacctatcagcaggaattgataaatcaaaaactgacgaatgatatttcggaacaggaaatagcggattattatgagaaaaacaaggaattgtttaaattggaatctccgctgatcaagggattgtttattaaagtaccgttgacggcacctcagctgaacaatgttcgcagatggtacaagacggaaaaacaggatgctgtggaaagtctggaaaaatatagtttgcagaatgcggtgaagtatgaatacttttacaataaatgggttccggttacggatgttctggacttgattccattgaaagaggcgtcaccggagcagtatgtagacaagcaccgacatgtggaactgaaagatacggcattttactatttcctcaatgtgagcgattatcgcggggcaggtgaagagaaaccgtatgagtttgcccggtcggaagtgaaggatttactggtcaatcagaaacgggtgaactttatggaacaagtgaagaatgacctgtatcagcaggctgtaaacaagaagaagattatatacaattattaaatacaaagaatgaagaagtttgtgaactttagatttattgttacccttgtcctggcagtatttgccaacgtggtaacttatgcacaggacaatgtaattgatgaggtagtttgggtagtaggtgacgaagctattttgaaatcagatgtagaagaggcccgtatggatgccttgtacaatggacgcagatttgaaggcgatccttattgtgtaatacccgaagaaatcgctgtgcagaagttattcctgcaccaggcaaagttggatagtatcgaagtttccgaagcggaaatcattcagcgtgtagatatgatgaccaatatgtatatccagcagattggttctaaggagaaaatggaggaatacttcaataagactgctactcaaattcgtgaaacgttgcgcgaaaatgcccgtgacggactgacagtacagaagatgcagcagaaactggtaggagatatcaaggtaactccggcagaagtacgccgctatttcaaggatcttcctcaggacagtatcccttatattccgactcaggtagaggtgcagattattacactgcaacctaaaattcctattgctgaaattgaagatgtaaagagacgtctgcgtgattatacagaccgtgtgacaaagggtgaaattgatttttctacactggcacgtctgtattccgaagataaggcttctgctatcaaaggtggtgaacttgattttatgggacgtggtatgctggatccggcttatgccaatgtagcattcagtcttcaggatccgaagaaagtttctaagatcgtagaatctgaatttggttatcatattatccagcttatcgagaaacgtggcgaccgtgtgaatacccgtcacattctgttgcgtccgaaagtatctgaaaaggagttgactgaggcttgtgcccgtctggattctattggcgatgatatccgtcagaataagtttacatttgatgaggctgcctctgtgatttcacaggataaggatactcgtaataatcacggtcttatggtgaatacgaatgagcgtacaggtatcactacttctaagttccagatgcaggatttgcctcaggatgttgcgaaagtggtggataagatgaatgtaggcgaaatttccagagcctttacgatgattaacgagaaggatggaaaagaagtttgtgccattgtaaaactgaaagcaaagatcaacggtcataaagctaccattgcagaagactatcaggacctgaaagaaatcgtgatggataagcgccgggaagaaatgttgcagaagtggattctgaacaaacaaaaacatacgtatgtacgtattgacccgaattggcagaagtgtgacttcaagtatccgggttgggtaaggaacgattgatgtttaaacagcttgactttatatgctgaaacaaaacaaaaaagataaacagcaagacgggcatagatggcttcttataggctttctatgcctgtttgccgtatgccttgtggcgcaggtgaagcctaccggacagactaaaaaggctgagactccggctgcgaaaactccaaatggaacgaagcaaactgataaagatatcaagaaagagcccgaaaataagaagacgaaagtatatttgcttcatgccaatcagggacaggccgacaagcttgcccgaccggatgttcaggtactgattgggaatgtaaagctgcgtcacgacagtatgtatatgttttgtgacagtgctttgatttacgagaaaaccaattcggtagaagcattcagcaatgtacgtatggagcagggggataccttgtttatttacggtgattatctttactacgacgggatgacacagattgcgcagattcgtgagaacgtaaagatgatcaaccggaacacgacgcttctgaccgatagtctgaattatgaccgtctttatgatctcggttattatttcgagggcggtactttgatggatgaagagaatgtgttgacctcggattggggagaatacagtccggctaccaaacagtcggtattcaatcatgatgtgaaattggtgaatcccaagtttgtcctgacgtcggatacactgaaatataatactttttccaagattgctaccattctcggtccttcgaatatcgtaagtgacaataatcacatctattcggaacgaggcttctataatacactcagcgaacaggctgaattgttggaccgttctatcctgacgaatgagggaaagaagttgattggtgacagtttgttttatgaccggaaagtgggatacggtgaagcgttcgataatatacgaatgacggataccattaacaagaatatgttgaccggcgattattgtttctataacgaattggccgactctgcttttgctaccaaacgtgcagttgctattgactattcacaaggagacagtctctttatgcatggagatacgttgcagcttatttcctataatctgaatacggactctgttttccgcctgatgaaagcttatcataaggtacgtatgtaccggacggatgtacagggagtttgtgactcactggtttataattcaaaagactcttgtctgaccatgtataccgatccgattctttggaatgaaggtcagcaactgcttggcgaggagatcaagatttatatgaatgacagtaccattaactgggcccacattatcaatcaggcactgacggtggagatgaaagattctgttcattataaccaagtgtccggtaaagagatgaaagcctatttcgaaaatggtgatatgcgtcatattgaagtgataggtaatgtgatgaccgctttctacccggaagaaaaagacagtacgatgaccggatttaataatatggaggggagtgtgctccatctttatatgaaagagaagaagatggaaaaagggatgttcgtaggtaagtccaacggaacattatatccgatggatcagatccctcccgacaagttgcggctatctacatttgcctggtttgactatgtccgccctttaaataaagaagatatattcaactggagaggcaagaaggaaggagagacactgaaaccaaccaccgaccggaagccaaagacagataagcgaagtttaattaatatgaagtaatatgggaatgtttttcaattcgatgagaaaacctcgaggctttaatcatcaatacatttacgtaaacgagcggaaagaaaagcttgagaagatggaggagaaggcgaaacgcgagttgggaatgcttccggataaagaattcagtcccgaagatatccgtggtaagtttgtcgaaggtacgacgcacctgaagcgcagaaaggcaagtggccgtaagcctgtatcttttggaatcatattgattatcatagctttccttttatatttgtggcattatttagcgacgggaagctggtcattttaactactaaataaactatgagcgatataattcatttgttgcctgattcggtagctaatcagattgctgccggtgaagtgatacaacgtccggcatctgttattaaagagctagtggagaatgcgatcgatgcagatgctcaaaatatacatgtgttagttacggatgccggtaagacctgcatccagattatagacgatggaaagggaatgtccgaaacggacgcgcgactttcctttgaacgccatgcgacttctaagattcgggaagcagcggatttgtttgctttgcgtacgatggggtttcgtggagaagcactggcttccattgcagctgtggcgcaggttgaactgaaaacacggttggaatcggaagaactgggaacaaaactggtgattgcaggctccaaagtcgaaagtcaggaagctgtttcctgttccaagggaagtaacttctctgtgaagaatctgttcttcaacgtgcccgcccgtcgcaagttcctgaaagcaaattcaacagaactaagtaatattctggcagagtttgaacgtattgctttggttcatcccgaagtagccttttcgctttacagcaatgattccgaactgtttaatctgcctgtatctcctttgcggcaacgtattcttgctatcttcggcaagaagctgaatcaacagttgctgaatatagaggtgaatactacgatggtgaaaatctcaggctacatagcgaagccggaaactgcccgtaagaaaggtgctcaccaatatttctttgtcaacgggcgttatatgcgccatccttattttcataaggcagtgatggaggcttatgaacagttgattcccgttggcgagcaagtttcctactttatttattttgaagtggatccggctaatatcgatgtgaatattcatcccactaagacagaaatcaagtttgagaatgaacaggctatttggcaaatactttcggcatcagtaaaggagtcgttgggcaagttcagcgccattccttccattgatttcgatacggaagatatgccggatattcctgcatttgagcagaacctgcctcctgcacctccgaagattcattataattcggatttcaatccgttcaaagtatcttccggtggaagtggcggcggatcatatagccgtccgaaggtggaatgggaaggactgtatggtggattgaccaaggcaagtaagatgaatgagcctcagcaggaaccggaaatggattgggaaaattctcctttcgaggaagaaccgatggttgctgaagagaaaactatttcggcggtatctgccgcttcctccactttctcatcggcttcctctactttatatgccaatgaatcggtgattgagaaagggaatctgcatttgcagttcaaaggtcgttttattctgacttcggtgaaatccggattgatgttgatcgaccagcatcgtgcgcatatccgcgtactttttgatcggtatatggtgcagataaaacaaaaacaaggtgtttcgcagggagtgcttttccccgagatattacagctgcctgcttcagaagcggctgtcctgcaaggaatcatggatgatttgtcagcggtaggtttcgatctgagtgatttgggtggcggtagttatgccatcaatggcattccttcgggaatagaaggattgaatccggttgagttggtacggaatatgctacatacagctatggaaaaagggaatgatgtgaaggaggaaatccagaatatcttagctttaacactggcacgtgcggcggctattgtctatggtcaggtattgagtaatgaggaaatggtaagtcttgtagacagtctttttgcctgtccttcaccaaattacactccggatggcaaaacagtcttgacaacaatcaaggaagaggacatcgagaaattattcaaataaaacaaataaaatcatcatttcttaaaaccttttagttcagttcgtgttatttaaatagttcaacaaagaaaagattataataaccacttaactattaggtatatgaaaaagattctaatgttgctggcttttgccggcgttgcgtctgtcgcttctgcgcagcaaaccgtgactgtaactgaatacgaggttattcaggtacaagataaacatcaagtaataactaacccattctggagcaactggttcttctctgtaggaggcggtgcacaggtattatttggtaataacgaccatatcggaaaattcagagatcgtattgctccgacattgaatgtgtcagttggtaaatgggtaacacccggtttcgggttacgtatgcaatatagcggactgcaatccaaaggattcaccaccaatgaatctgcaaattatgtagtcggtggcccgagagaagatggctcctacaaacagagatgggactatatgaatcttcatggcgacttgctgattaatctgaatgcacttttcggtggttacaatccggatcgcgtatatgagattattccgtatatcggtgccggttgggctcattcttattctaagcctcatacaaacgctgctaccttcaatgcaggtattatcaaccgtttccgtttgtcaaacgctgtagatttgaaccttgaactgagtgcaacagggctggaaggtaaatttgatggtgaacatggtggcaaacccgattatgatggtatcttaggtgctactctcggtgtgacttattacttcccgacccgtggattccaacgtcctgttccacagattatctccgaactggaattgagacagatgcgtgatcagatgaatgctatggcagccgcaaatatgcagttgcagcaacagttagccaatgcacagcagcctgtagtggaagaagctgaagaagtcgttgtaacagatgccaacattgcaccgcgtactgtattcttcaagatcggttcagacaaattgtctccacaagaagaaatgaacttgtcatatcttgccagcaagatgaaagaattcccgaacatgacctatacaatcaacggatatgcagactctgcaaccggtactccttctatcaaccagaagttaagtctggaacgtgcacaagctgtaaaggacctgttggttaagaaatatggcatctctgcagacagactgtctgttgcagcaggtggtggtgtcgacaagttcggtcaaccgattctgaatcgtgtggtattggtagaatcagctcaataatacatttgatattgtaatatagatacggctgttaagtgggccgtatttatgaaaggaaagacttgctcaggtaaagatatccctcggatactttacttgggcgagtctttttgtttccaatgatttgcatatcctataattttttgcgaatattgcaatcaaatgcattggtcttagacataagtttcttacttttgaacaaggattccggtttttatgattgttactatgaaatgtagataccttctatctttagtctttttattgcatatatgggtatgcaagagtaatgttatagataatagtgtctatgattatggtcttacgtttctggctcattctaccaatcaggatcagcggaccaatctggatcttactcctgcggcttctttgtcttttcccgaggacggtttctcggtgggattcgatataaagttgagaaatgaactgtatacttatggttatgttgtacgggtcatagcagatgattcttcctgctttgattttatctcctacctgctttattcccgatttaatattgtattgactgacaaagaccgggtgatcaagaatacggagattgcagattcggtaaagattgtagcagacagatggatacacgtcgatctgcaatttgccaaagaccggattcatattgctgcagacggtatccaggcggaaatcaatcattccctgagcaactttaaggatatcaagatctatttcggaggcagcaagcatccccgtttcttctctacagatgtacctcctatgaccattcgtaatatagaacttgctgatattcaaggtaaactgctttataaatgggaattggctgctcatgataaagatgtgacttacgatagtgtcagaaataaacaggcttttgtacgtaatggcgtctgggagatagataaacatactaaatgggcggcattagcttcgttgaatgtgcaccatattaatccgcaggtggcttatgacgatgtgtcgggacgttttttcatagcaggaggcggtcagttatttgtttacgatgtgaaggcgaatcgtattgattcgattgcttataaaggacatccttatataggagcttccagccagattatttttgatgccaaacgaaacaggctcttgtcttatacaccggatttcaacgatttgaatgtctatgagtttgaccggaaatgctggacattagaaactccggtaatgattgatacccgccagcatcataatcgtattatcaatcagaaaagagatgaactgattgtttttggtggctatggtaatcaccgctataattcacagttgagcagaataaacctgtctgatccgcaggggtggtcgatcagttcccttgattcctgtctgtttccccgctatttaagtgcgatgggggcggagaatgaggactacttattgatcatgggtggttatggcaatcagtcgggtaagcaggaagaatctccaggaaacttttatgatctttaccggttgaatttgaaaacaggtaaatgcaccaagttatgggagtttgtgaatgacaggcagcactttactttcggtaattcaatgattatcgatacaccgtcgaatagtgtatatgctttgacatataataatgaccggtataatacttttgtttatttgagccggtttgatatacagaccagacaaccggttcaggaagtgatgagtgattccattgtttataacttcctcgatattcattcttattgtgatatgtttctgcataaagagacatcttctatttatgccgtggtgttgcaggaaaaagagcccggaatatctaaagtcgaattttataaactggcatttccacctttgtccaaggaagatattttgcctcatcagactggcggaatgaagccggtgatattgatatccggtattttggcgggactactgtgcctgataggaggaagtatatggttattgcatagtaagagaaagagaaaagtgaatgtggcagtcggtccggttgctacggaagaagtaaaagacagatcggtcgaagaagaaccgaccgaacaaaaagtatcttccgttttattattgggcggatttcaggtctttgataagcaaggcggtaacatcacgggagattttacgcctactcttaagcaattattcttgtttttactgctgaataccatcaagaacggaaagggaacaacttctcaatgcctggatgaaaccttctggttcgatatgagtaagtccagtgcatcgaataacagaaacgtgaatatcagaaagctaaggctgatcatagagaaaatcggagatatcaatattgccaataagaacggctattggtatctgaatctggggaaagacgtgacctgcgattatcaggaagtgatgagattgctggatcagataaaagataccattacggacaaaaagataatcaataaaatcatatccctggcgagtgccggcgcattgctccctaacgtcagtgccgaatggattgacgaatataagtcagcctactacgttctgttgacggaaatactgctttctgtggtcaaccgtcccgatataaaagaagactccaggcttttgctgaaaatatcagatgtaattctgcttgttgataatatagacgaagacgctatccgcactaaatgcagagtcttgtatcagatggggcagaaaggtttgtccaagcaaagtttcgataagttctgtattgaatatgaacgtttgctgaatgccaagcctgatttctcttacgatgatattataaattcactctaaattaatcctctattaataattttccggtgcttcctgttggtcggtggagagatagttcctcatcggtggcggagcctgtcctcatcggtgccggaaataggtctcatcggtacccgaaataaatccttgcggagtaaggcactcattataccatcaaataataattgtttttttttatcatgaaaacattattgataactagatacttatgcgaaaagaatgaaattctttatcgctattaatctaaaattaatatggcattaaggactggaattctatatttgcttcagaaacggacgggatatcctccactatgtttctgatgacttgagcggatcgaactataaccttataaaatgatggaaatatgaaaaacgacacttcttaactactgcttggacttacttgtcagagaaagttttcttgagatgaaaacggtttgaatcaattaatgttaatctataaattatgaaaacaggaaagagcaaagatcatttgcaaagagtttttttaaggttcctttatttgataatggggagcatcctttctttggattctgttatggcgcaggaaaacctgaaaatttccgggcaggtgacagacaataaaggagaagccattatcggagcctcagtgaaagttctgaaaacgggtacggggactatttcggatatggatggtaagtttactattcaggttcctgtgggagctgaactggagataggatatgtcggctataatccgaagagagtgaaagtggtgaataaaaacttcgtaacggtagtccttgaggagaatgtggtagcattgggcgatgtagttgttgtcggatatggcattcagaaaaaggaaagtctgacaggagctatcggaaacctgaaagtagatgatatcgtaaagaccaaggcacctagtttggcacaggctattcaaggaaaggtagccggtctgcggatcagacaggagaatggagagccgggtaagttcagttccaatatcaatgtccgtggcttcggaactcctttgtttgtgattgacggagtggtgagagacggttccagcgaatttcaacggttgaatccggaagatattgaaagcatatcttttctgaaagatgctactgcctctatctatggtatgaattcggcgaatggtgccgtgattgttaccaccaagaaaggggctacaggcaaaccgcgtattacgttgaacgccaatgtcggcattacttctcctaccaatgtgccggagatggccaacgccagacaatatatgaccatgcgaaatgaggcggaaatcaatgcaggcagaccggcttatatcacaaaggacgaattgaccaaatggcagcaaggtgctcccggttatgagagtgtagacttgtatgatgccgttttcaataagcacgccacacagttccagacgactctgtccctggaaggtggtaccgacaaagtaagttattacggtagtttcggttatgccaccgataacagcttgttgaagaataacgcattgacttatgataaatatacattccgttccaatgtcagtctgaagattaccaaagacctgacagccagtatcaatcttggcggacgttatgataccaccaaccgtccctggtttcctttctatgatatatttaagagtacgcgtgtaaatccgccgactacttctatctatgccaatgacaatccggattattataataacttctcttatgttcctaatccggcagctatgatcgatgccgattataccggcagcgctaaagagcggaataagaacttgcagacacagtttgcattagagtataatattccttatgtaaaggggctgaaggtgaaaggtacttttatctacgattacaataactacggatataaggctacgcggaaaggttttaagacatatacctatggcgaatatacgggcgagtatacagcggcagatgccaactatccggctttgcttcaggataatcgcagagaatcggaacgggtggatatgcagtttcagacaaactataacagaacgttcggcaaccataccatcggagctacttatgtcttcgaaagacgcgaagagaaagcaaactggatgaatggtgagcgcaagtttgactttttcacaatcggtgaactggacaatgcacgcgaatctgaccagaaagtatccggttcctcggaacaccaggcttatctttctcatatcgggcgtctgacctatgattataaaggcaaatatctggcagagcttgcttgcagatacgacggttcttatcgatatgctccgggcagcagatgggcattctttccgtccgcttccgtaggatggagaatttcggaagagagctttatcaaagacaacttcaagtttgtcgataatctgaaacttcgtttctctgccggtcgttcggggcaagatgccggtgatccgttccaatacttctccggttacacgttgaacagtggcggatatgtattcagccagggaaattataccaatggagtagcttctcctgtgatgatcaataagaatctgacctggattaaagtgaatatgtataatattggtattgacttttcaatctttaaccggctgatcgcagtagagtttgatatttatcagcgtgaccgcagcggcctgttggccgaccgttacggttctcttcccaatacgttcggttccaagttgccacaggaaaacctgaacggcgaccgtacgaggggtattgaatttacattgactcataccaacaaaatcggtgatttccactacagtgtatccggtaactttaacttggcgcgtacccaacgccgttatatagagagcggtccttacaagagcagtatggaaagatggagaaaccagtcatccaaccgctggggagattttatctgggggtatcagacggacggacgtttccagaactttgacgagattaatacatatccgattcagaatggggataacggaaattccaaggaacttcccggtgactacatcctgaaagacgtaaacggtgacggagtggtgaatgatctggacaagacccctttattctggtccggcagcccgttgattcactatggtttcaatgtggaagcatcctggaagaacttcgacttctatgctctttttcaaggttctgccctgtacacggtgcagtttgacgaggtatacgcaaagatgctctgtttcaagggtggcaatacccccgaatacttctacgaccgttggcatctgtccgacccgtatgatgcgaacagtgaatggataccgggagaatggccggccatccgtctggagcaggacatgggatcgttctatacgagggattcgcagatatggcgtaagaacgcttcttatctgagactgaaaacaattgagatcggctacaccttcagtccccgactgatgcataaactgggtatcggtagtttaagaatctatgcgaacggaaataacctgtttactgtctgtgacccgtttgtaaaggcattcgatccggaaaagattgaaggagactatagtgccggcttgaattatcctctgaataagagctttaactttggattgaccttgaacttttaaagaagatgattatgaaaatatatagttatttattattgggagctatgttcctgctgggcggatgtagcgatttgcttgatatcgatccgaagaataaaattccggcggatgaattgttctctactccggaaggagtacaggcacatatggccaatctgtacggtcgtttgcctatcgaagattttacctattcaccgaatcgcggcttcaatgtgggagtcggtacggatgtgaataatgccggttttatggctgctcatttctgtgatgaggctatccatccggagtacaatgactttggagaagagtggttcgattattgggaagacggttataaactcattcgtgatttaaacagtctgttggttactattcctacattgaccagtattaccgaacagcaaaagaatgagatcaatgcggaaactcatttcctgagagcttatacctattttgccttagccaaaagatacggtggggtacctatcattaaagaaccgcaggagtataacggtaatatcgaagaactgcgtgtccccagaaatacggagaaagatacttgggactttgtcttggaagaatgtgaccaggcagtatcgctttttggagatgcgaatgaaaatgatgtgctgagagcgaacaaatgggtagcattggcactgaagtcaagagcagctctgtatgcagcttccgttgccaagtttactcatcagccttatgtctctttctctggtccggctgttgaccagaagctggtaggtatagaagttatatcggctgatcattattatgatgaatgtatatcagcttcacaggaaatcatgaatagtggtaagttcggtctttacaaaccttcccccgctactccggaagaagcgacaaccaactatcaaaagttatttgaacaacctttccaatgtctggacggattgaaagagcctatcttcatgaaggcctatgctgcaaataccattctggcacataactatgatgtctggttcagcccccgtcagatgatcctcgacccgaatctctatcccggtcgtatgaatccgacactggattttgtcgactctttcgaagattatacggatgacggaaccggaacacccaagccgatcagcactcgtgtggatggaaatgaaagtgattataatggatttaacttatccacccgatacctgtctttcccgatagataaaccttaccaggcatttgccggtcgtgatgcccgtttgagtgccatggtgttattcccgggacagaacttcggaagtacgaagatcattatccagggtggtctggtgaaagctgacggttccggttatcattataggactcaggcttcggagaagggacaggatggtctgatctattatacttacggagcggagaaaagcacggaatattcaggattcgatccgactttgggacattatacccgcagcggattcctgtttaagaagttcttgcagatagaaagtccggttgagcaggcatggagtaaaggtacacagccttggatcgatttccgttatggggaaattcttctcaactatgcagaagctgttatcgaaaagacaacctctacttctgctgaaaaacaggctgcacaagacgctttgaatgcggtccgcaaaagagcggctcacaaagatgacattgcattgactcaggcgaatgttcgcaaagaacgttttgtcgagctggcatttgaaaacaaacgcagatgggatttgtcgcgctggagaactttccataaggaatttgaaaaccgggtgagaaagggacttgtacctttccttgacctgcggacaaatcctgcgcattatgtatttgtacgtgtcaatccgttgggcattgaatcaaagacctttgattatagctggtattataagagtattccgggtacgggggctaatggtctggtacagaatccttaattagtatattctaaaatatagattagatatgaaaaagcttctatttttattatgcgttgtagtagcaggcagtatgttttactcttgtgaaaaagataatctcgaagggccggatgcaatctttgccggcgaactgagagaccggaagaccggagaactcattcaacaggagatatcggacggttcccgcgtttatttcatcgaacaggggtggggagataatcctcctgttcagaatatggtcgttaaaaaagacggaacgttttataacggtatgattttctccggtgactataaaatcatcctgaatcgtgggaactacgttcctttggatactctggatatgaaaataaagccgggaaagaattatcaggtcttcgaagtgaatccttatctgcggatcattgaaccggaaatatctgtgatcggaagaaaggtagtggcgaaattcaaactggagcaggtgaccagtaacgaggtctatcgtatttcgttgtttgcacactctcacatcgatgtatccaacaaactgaatattgtcaaccggacagaagaactaaaccgttccattactgatggtgaggctttcgaattgtctatcaatctggaagactacacttccacgctggttccgggcaagagttattatttccggatcggtgcacagtctcacggaagtgagacaaagtacaattattcggcatctgtacagttggatatttagcataaaaacggaaaagccatgagaaagtatttacagttggtattccttgcggtctctgtcttttgttcagagatattgttggcagaatctcgtgatccggtccggatactggatttgagaacgctcaatgaacttgatctgaaagaacaggagaaggcggagcaactatgggacattatgcatacgacagctaccttgcaaggcattgtgaatcggaatagtccgagattgtacattcgctatgtcaagaacgggcagggagagaatgtcgatgattattggtggaataaataccgtcaggcaggacagtggctggcgggacgtgatacgatagcttacacggaactgtcggatgtcgtgaccgttttcagaaaagaaatacgcggagtggttgtttatgactcaaaagtagcatctaccagtaatattgcttcatctgtggcaggaatcgagaatctgatagctgtgcgctatgacatatctcccaatagtctctatacccgtttggtactgcaaggaccgaagctggctgtgaaatgctggctggtgaacaaagatggttcttctcttttcacgggcaaaggaaggattgccggaaccggtcaaccttcgacaggatctctgaaaatcgatccctatgtatggtttatagagaaatacctgaagaaagggttatgcaatacggagtacgccgcttattacatcgaccagttctggcgtaccgatcctacccggacggtaacgaaccatcaccaattgaccaatcatgacttttttgtcagcaagaaagcttttttctttgacctttctccttggggagacgagccggcaacggatgatccgacacaagaagaaggactggacttgcagatactgaaaacttttctgcaagaagcctataagcaaaataaaggagagaaattctgctatatcggaggtttcccgagctggatttataaatatacgcagcatgctggaggaaagcatgaagatgtagctaccgagtgggaattttcccgtattatcagtgcttataatgcctttaaggatgccgatgccatcggactgggagcattggctaactcctccttctggcaacattttcctcttcaggaaaagtatccccaaaagtgggtgacacatcaggaactgatggacagaggctatctgaaccgtgacggaacaatcaactttcagggacggaactttatcctcttctatgtaggcgattatgattcctcctcctggattgctcagactacccctttcctgtgggacgaacctagccggggagaagtgcctttgatgtggtctgtcagtcctgtacttgcagaacgcgttccgatggtgatgcataattatcgggtgacggctactccgaatgattattttgccgctgctgacaatggtgccggatatttaatgccgggtatgttgcaagagcctcgctcggtgtccggattgaaaagcggattgagtgcatgggcaaagcattgcagcaaatattatcagaagtggggattgaccattacaggatttgtgattgacggcgaagcccccggactggattcagacggattggactgttacgcatcgttcagtccgaatggaatagttccgcagaagatgcctttgacattgctgcacaatgatatgccggtgatccgggcagattatgatattgtagatcatgattaccgcagggcaacggatgtgattgtggaaagagtggagaaacgtccggttcctttccattggttcagagccatattgaagtcaccttcctggtataaagggatttgtgatgagttgaaacagcggcatacgaatattgaattgctggatgcaccgacattttttgaactctatcgtatctatctgaagcagcatccggatgctgctgccggaaagataacgatgaactaacctgattaatgaacagacatattcatatagaatgatgatgaacagattgaatataaaaagaacagtcggctcctgtttgatggcgatggcgtttttttcgtgtacccatacggatcagacgcccacgaaagactttgtcgattatgtaaatccatatatcggcaatatcagccatctgctggtgcctacttacccaaccgtacatctgccgaactcgatgctcagggtctatccggaaaggggagactatacatcggacagggtaaacggccttccggtcgtggtgaccagtcatagaggcagctcggcttttaacctgagtccggtgcagggagaggtatcccgaccgattgtatcttactcctatgatttggagaatattaccccctatagttattccgtatacctggatgaggctgatatacaggttgagtatgccccttcacatcaggctggtatttatcatatcagttttgggacggaaggtgataatgctctggtggtgaatacgaagaacggaaagctggtcgctgaagaaaaaggagtcagtggctatcaggttattgacaacactcctaccaaaatctatctgtatctcgaaaccagtcaactacctttacgcaaaggggtactggcagatggaaaagttgatatggaaagtaaggaaggcagtgccatcgctttgtattatggaagcgagaagaacctgaatctacgttacggaatttcctttatcagtgccgagcaggcaaagaagaatctgcaacgtgacatcaccacctatgatgtaaaggcggtggcggatgccggacgcaggatatggaacaagacattgggcaagattgtgatagaaggcggttcggaagacgaaaaagaaatcttctacacttccctttatcgtacctacgaacgcatgatcaatctttcggaggacgggaaatattacagtgctttcgatggcaagattcatgaagatggcggagtacctttttatacagatgactggatatgggatacttaccgggctacacatccgttgcgtatcttgatagaaccgcagaaggaactcgatatgattcgttcatatatacggatggcagaacagtcggacagaagatggatgcctaccttccccgaggtgaccggagacagtcaccggatgaatggcaatcatgcagtggcagttatctgggatgcttattgcaaaggattgaaagactttgatctggaggctgcttatgaagcctgcaaaggagcgattacagaaaaaacgttgttgccctggctgagatgtccgttgacggagctcgataagttctatcaggaaaaaggatttttccctgcactgaaccctggcgaagaagaaacttgcaaggctgttcattcgttcgagagacgacaagcggttgcggttatgttgggtaactgttacgataattggtgtctggcacagatagccagaacattaaacaagaccgatgactataagaagtttatgaggatgtcttatacgtaccggaatgtttataatgcggaaacgggtttctttcatcccaagaacaaggacggaaagtttatcgaaccgtttgactatcgatattcgggaggacagggggcacgtggctattatggtgaaaacaacggttggatctatcgttgggatgtgcagcacaatccggcggatttgattgccttgatgggtggacaggcttcatttatcgagagattgaatcagacattcaatgaaccgttggggcggagcaagtttgatttctatcatcagttgccggaccataccggtaatgtcggccagttctctatggcaaatgaaccttgtctgcatattccttatttgtataactatgccggtcagccgtggatgacacaaaaaaggattcgcgttttgctgaaccagtggttccgtaatgacttgatgggcgttcccggtgatgaagacggaggtggaatgactgcatttgtggtattctccatgatgggcttttatccggtaactcccggttctccaacttataatatcggcagtccggtattccaatccgcaaagatggaggtaggtgacggacattattttgagatcatagcggagaattatgcgccggaccataagtacatccagtcggctaccttgaatggaacgccgtggaataagccgtggttcagccatgcggatattcaaaacggcggacgtctggttttgcagatgggagataagcccaataagaagtgggggatagcttcggatgccgtgccgccctcttcagagagtttgccggaataaagtcagaataataatattaaaatctaaaatataacacaatgaaaaagatgattgtactcaccagtctatggtcgtttttatttatcttttccttttcaatgttcggttgcagcgaggatgacgatgaatttggaacaacggccgaaagaggaaatgaagtccgtactccccgtgtggaggagatcaatggaaaagcagtggtcacctggattgatccttatattacggatatcaaggaggtgcaggtaaaggatttgcagactaatgagcaacagacggttgccaaaggagtgcagagcgcggaatttgcgattacggacaatagcctgttgtcttaccgatatgaaatgaaagttgtcagaacgaccggagagatgtctgccggagtgactgcccgtctggtgaagaactgggcgcaaaagctgcatcctttgatggattatcatagtgatgcgactcctcaaagtggtatgttctttaagaatcagccggtggcgaaagtgaatgtattcgatattcgtgatgacgaaaatatatcgaagctgaccactgctgtcatgcagggagtgattaaccaggaacaggcactgacttatctgatctggttacagcaggatttgacgcagctggatgatgccgaagtgcagtatgagatgcagcctttggcgaatacttcccgcaacagaggctttgcggcattatataatatgtataaagaccgcttcaactgcctggtagtctgggatgagaatcagccttggtcatggagtatggcacagatgatttcgtcacaggagaaaggcattccggttacggaatccatgagaaagtttatagaggatgagctgggaataggaaatctggaagttagggatatacgtaaccaatggtcatcaaaggcagaagcttatggctgggcgatagcgcactatgccgacaaatgccatccgaagctaactttctccggtggattgcggagtgattataaagataatccgtggagaatgtacgattacgtagctgcttctaaaggctttgtcttctggttggacgactctaatggagatgacaaacagatcatggataatatcttcaatagcggatcttatccggtgggttcttcggtatttggttatggaatgaatgccaatggcgacgaactgaataagattaccaacatccataatgcaggatttgtagtgagtgactattatgcgaatggcagttattggtgcagtttcccgagcaaagccttccagcagcgtaaagggatagccggagaagtgaagccgggtaagatatatgtcgctatcagtctgagtgacggagacaatattcagttcgatgcaaattctctttatcagatattcaaggaaggaaagcgcagaggcgaagttccggtaggagtgactttggcggcaggcttgcaggaattgaatccgaagctacttgaattttactataagaatatgactccgaacgatgaattgacggcagggccttccggtttccagtttatctatggtgattattatgcgcagagcggtaaatatgcggaatggttggaaatgaacaagaagtggttatccactgccggtttccacacggcgcatctctggaatacagacgagcagatgtatttcgaacaatacatgaagagcaaggctgtcgatgcgattatggacggatctaaccggacacataccacaggctcatcttacaaattggtagatggcgtggtgcgtattgatcaggggactatgtgccgcaataatggagacgtataccgtgatctgatgtctgtatctcccagcccgcggcgtcctttattccggcatgtctatctgttgaccaactattacggatttgaaggaaataaagtggtagtgtacgagagactgatcaaggaactcgaacgggttgaacaggattgtccggatacgtatgaatttatgctcccgatggatttggccgcttctatcaggaagtacatagaagaaggcggtatttattaaaggaattataaacgaatctaaaacaaatgagatatgaaaaatagatatagtatccggttactggttatagtctttctttcggctttcgctatgggtatctgctactcatgttcggatgatgacggagaaggagtgaaggtatatgagtatcgtgaacagataggcaagaagataaaagtgttgaccgacctgcaggctgaatcccagttcgggcttcgggaaggaatgtatcctgaaacaagccgggcgattctggaagatgcgatagccaagctgaaagatttccttcagacgataaaagaagcgggagtggcggaagctcggattcccgaagagacagccagactgctgaaagaatcggacgaaaagatagccgagtttaaggcgactgtccggacggaagacttactggttccggcagagctggaagtaagcggaaagaatggcggatatattgactttggcgctcatccggagtattccacattcggtgaagttggcaagcaggcatttactgttgagttttgggtaaagctgaaggatgtagaaggcttcttctatctgatctctacctttacggatgatgatacgaacaatcacgaacgcaaaggctggtgcgtgaatagctacaactatggtggcaacaacatgcgtatgacatacggaatgggctttaatgacctgatggaacctgccttcggatttgccaccgttaatgagtgggtacacttggctgtggtgacggatgaaaccggagtagacggcgagatgaatggaggcagacctgtcatgaccaaaatgtatatgaacggtgaactgaaactttcgaccacctctcatcaggatgcttccaaaccgtatgcttctaacgacagcaatgtcccgatggtggcatttggcggcatgagtgctacaggcaaccgtatcggtgataaaggtgctaacggaagtatgaaacatctgcatatctggcgtaccgccaagactcaggatgaaatccgccggttgatggagcatccggagaatgtgacgggcgaagaggacgatttggtttgcggatggactttcgcgaagatggcgcttgacgaccaggaaattaaagacttgaccggaaagtatacggcaaagctggtcggagactataggtggattgaattagaatgatacgaaacagaaaatacaggatagatatgaaaaataactatttatataattgggtagtgatagtgtttatgatgcttcagatgctggcatttacttcttgttctgatgatgatgacaatagcggctggccgacggaaacggacaagaccgaaatcttcatagagcgcttcagtacattggtgactaacctgactgcgctgcgggatggagctacatatggcgaactgaaagataactatccggtatccagtaaagccatgctggatgatgaaattgtttatctggaggaaacgatcgctaaactgaaagaaggaaacaaaaagttggctgacagtgaagccgaccgcattatccgtgaagctaaccagatagagaagaacttcagagcgaccagacgtaccgaagactttttaccggttgccgctgaactgttggtcaacggaaagaatggcggatacattgattttggtgttcatccggagtattcagcttttggcgagcaggggcaacaagcattcacagtcgagttctgggtgaagctgacagatgtggacgaatatctcaatagctttgtattcttgctttccaccttcacggatgatgatacgaaagatcacgagcgtaaaggatgggcggtaaacagtcacttcggcagattacgtatgacgtatggtataggctatagtgacttgtttgaaccgggcttctcattcagcacactaaatcagtgggttcatgtggcagttgtcactaacgagaacggagtggacggagaagtcagagacggaattccggtgatgaccaagatttacgtcaacggtcagttgatgttgtcggaaagaggccgggatgaccgtttgccatatactccgaatgataaggaagtggctatggttgcctttaccgggcttagcgcaactgccaaccgtatcggagaaaagagcaccaatggatgtatgcgtcatctgcatatctggaaatcggcgaagacacaggccgaaatacaacatctgatggatactccggaatccgtgactggaagcgaatcggatctggtatgcggatggacattgaataagactgtttcggataacaataacatcaaagatctgacgggcaaattctcagccaggctgatcggagattttcaatgggtagagaatagataattgttttacgaaccgggtagttcccaaggccgtcggatagctggctttgggactactttcttaaacaaacgaacatgaggaaagaacttgtttttgttttattggcattatttctgtgtgccggctgtaacggtaacaaaaagaaaatgaacggtgaacacgatttggatgcggcaaacattacgttggatgaccatacgatcagtttttattataattggtatggaaatccgtcagtggatggagaaatgaagcactggatgcacccgatagcccttgctccgggacattcgggagatgtcggtgccatatccggacttaatgatgacatcgcctgtaatttttatccggacctcgggacgtacagcagcaatgatcctgaaatcattcggaaacatatccggatgcatataaaagcgaatgtcggcgtactgtctgtcacttggtggggagaaagcgattatggcaaccaaagtgtgtctctcctgctggatgaggctgccaaagtaggggcaaaggtgtgctttcatatagagccttttaatggacgcagcccgcaaacggtaagggagaatattcaatatatagtggatacttatggtgatcatccggctttttaccgtacgcagggcaaacctcttttctttatctatgattcttatctgatcaaacctgccgagtgggcgaagttgtttgctgccgggggagagataagtgtgcgtaataccaagtacgacggtctttttattggtctgacattgaaggaaagcgagttgcccgacattgagacagcgtgcatggatggcttttacacttactttgctgcaacaggtttcacaaatgcttctactccggccaactggaaatccatgcagcaatgggcaaaggcacatcataaattgtttattccgagtgtcggtccgggatatattgatacccggattcgtccttggaacggaagtaccacccgcgaccgtgagaatggaaaatattacgacgatatgtataaagctgccatagaaagcggtgcttcttatatttcgattacgtctttcaatgaatggcatgaaggaactcagatagagccggctgtctcaaagaagtgcgatgcttttgaatatttggattataaaccattggctgatgattactatttgataagaactgcctattgggtagatgaattccggaaagcaagatctgcttcgggagatgttcaataatatgctatatcttgccggttttgcccatttgtaattaaaatgttctatatttgtgatacataactcaaatatagaacattatgggtgaactttatggcacatgtgcattgcttgctgcagtgttgttttttgttctgctgcaaaagtttgaaagccggttcggcaaggtagacaaagagcttggcgagataaagaaacgaatggacgacctgctcaaagctcaggagaaaatggcctccggccctgtaagggccaaagaggatgtaccggcagagactttggaaaatacggatatactgccttatgtaacagaagaattgcccgattcgacagtgacagccttgaaggaagagaaagctgtcgaagaaaaaactgttgaaggcatacagcccattatggcggaaactacgccgcagaaattaaacgcttcccttgaaaaagaatctgctgaggccactttgcaggaaacttctccggaagctcctttcgaaataccgtctgttcccaaacggaagcaggttaactatgaaaagtttatcggtgaaaatcttttcggtaagattggtattcttgtattcgtcatcggagtcggcttctttgtaaaatatgccattgataaagactggattaacgaaacattgcgtaccgtacttggtttcctgaccggctccgcattgctggtagttgccgaacgcctgcaaaagaagtaccgcacattcagctccttgcttgcgggtggcgcctttgccgttttctatctcacggtcgccattgcctttcatttttatcaccttttccctcagacggtcgcctttataattctgatagccataacgttgttcatgtctatcctgtccattctgtatgacaggcgcgaactggctatcatctcacttgtcgggggatttctggcacctttccttgttagcaccgggaatggtaactacctggtactgttcacttatatgagtatcttgaatcttggaatgttcggactgtccatctataagaaatggggagaacttccggtgattgcatttgtttttacttatgtggtaatgggaatcttcctgttgacaggctttactaccggatcgacacatatttccgtccatctcttcatctttgcgacgctgttttatttcatcttcctcttgccgatattatcgatactccggatagaagctgtgaaaaagaacaggggattgctgctggtcatcataaccaacaacttcatttatctgttattaggaatcctgttcctgcgtaatatgggactgccgtttaaatcggaaggattactgagtttattgatcgccatcatcaatttagttttagtcatctggctacggatgagcaagaaagattataagttcctcatttatgcgatgttgggactggtactgacatttgtctccatcactatacctattcagttggatggaaattatatcacgttgttctgggcagcggaaatggttctgctgttatggctttacgtaaaatcgaggattggagtatacgaacgtgctacacaggtattgatgggactgacccttgtttcatatctgatggatatatataatgtactgatgacctcttcctcctccgaaaccattttcctgaacagttcttttgctacttccctgtttgtcggtctggccacgggagcattcgctttactgatggggcgttaccgttctctctttgccgcagcccgctatctgagatacactccctggaattcgattatgcttcttgctgctgccattattctctattatacatttatggcagagtttgccttgcacttggcaggagctacaagaagcggaatgatgttggcgtttacttccgctgccatctttatcctcagctatgctttcaaaaagcgcttcccgatagaacaatacataatcccttatctggcagctatgggaatgaacgtgctgatatatgcgattaatatatggggagaccagtgggtatacacgagcctgactcctgctttgcttcgatggcttgcggcagcgtttgttatagctaacctgtactacgttgcccgtcaatactatacattaataggattgaaaactcctttcactgtttatctgaatgtcctggcactctttctttggctgacgatggcacgttctttcctcctgcaagcaggagtagaggatttcgatgccggcttctccgtttcactgagtatcgcaggatttattcaaatggcactgggtatgcgtctgcatcagaaagtactgcgaatcatcagtctttcaacttttggcatcgtcctgttgaagctgattctgaaagacttatgggcaatgccgacaatcggtaagatcattgtatttatcattttaggattgatcctgctgatcctctcattcctttatcagaaactgaaagacgtactctttaaaaatgatgaagatgaaactgattgagcatactatataataaagtaaaggctgcctgtttgaaagtgaacggcagcctttactttattatattcgtctttattatctttattcctgtgaagctgcgaagcgtttcacctgctcttcaatcagttctttatcatcaaaatagttgattttcatagccttcttcacatccgccaatgtttcggcagcggcagctctggctacttcgcatcctttttgtagcatctcgtaaacggcaggaatatccttgctgaactctttacgacgattgcggatcggttccagtgtttcctgcatgatagcgttcaggaagcgttttaccttcacatcacccagtccgccgcgttgataatgtgctttcagttcatccagattcggataatccggcagatagcgttcgaagtgttccggacggcagaaagcatccaggtatgtaaatacggtattaccttcaatcttgcccgggtcctgaacacggagatgtcccggatcggtatacatactcatgattttcttctgaatttcttccggttcttccgacaggtagatacagttgccgagtgatttactcatcttggccttgccgtctgttcccggcagacgcaggcaggcagcgttgtccggcaacaggatttccggttctaccagcgtttcgccatagatatagttgaaacggcggacgatttcacgagcctgttcgagcatcggttcctggtcttcaccgacggggacggtggttgcccggaaggcagtaatgtccgcagcctgactgataggataagtgaagaatcctacagggatgcttgcctcaaagttacgcatctgtatttctgatttcacagtcggattacgttgtaagcgggatacgcttacgaggtccatatagtagaaactgagttcgcaaagttccggaatctgtgactggatgaagatggtagccttggacgggtctattccacatgccagatagtcaagagcaacctcaattacattttgacgtaccttctccggattatctatattgtccgtcaacgcttgtgaatcggcaataaagataaacatcttactataatcacctgcatcctgcaggtcaactctgcgcttcaatgaacctacatagtgtccgatatgaagtctcccggtagggcggtcaccggtgagtatgattttttcttttcccattgttgttaccttattataatagatttagcgacaaagataaggataaaaaatgaaagatgcgtcaaaatggagctacttcgttactaatgcttactattgctggcttttggtatcagatggcaggggaacggtgcctgttttcacagcaacaaagcaaataaaagagaatattcttcttcaaattctttgtagttttagaaatatgtcgttactttgcacaaattttgaaatcgacaatgaatcaacaagaaataagaagtaagtattatctacattcggatgttttccacccggaatcaacaaccttcttcttttttctccaaaaacgatattttagttctttggtaatgcgttaatccttttacgagggtaacgcattttttttattggcaaaacttagaaataacaacttactataacaacaaaagaaatggaaaaggaaatcaagaaagttctcgttttgggttctggagcactcaaaatcggacaagccggagaatttgactactcaggctcacaagcactgaaagctttgaaagaagaaggtatcagctcagtattggtaaacccgaacatcgcaaccattcagacttctgaaggaattgccgataaagtgtatttccttcccgtaactacttatttcgtagaagagattatcaagaaagaacgtcccgacggcatcctgctggcatttggcggacagactgcattgaactgcggcgccgaactgtacacacaaggtattcttgataaatatggagtgaaagtactcggtacatcggtagaagctatcatgtacacggaagaccgtgacctgttcgtgaagaaactggatgaaatcaatatgaagactccggtaagtcaggcggtagaaagcatggaggatgccatcgctgctgcccgcaagatcggttatccggtgatggtacgttcggcttacgcgttgggaggtctgggtagcggtatctgcgctaacgaagaagaattcctgaaactggccgaaagctctttcgccttctccaagcagatcctggtagaagaatctctgaaaggctggaaagaaatcgagttcgaagtgatccgcgacgcgaacgaccattgcttcactgtagccagcatggaaaacttcgacccgctgggtatccacaccggtgagtctatcgtagtagctccgacttgctcactggacgacaaagaactgaaactgttgcaggaactgtctacaaaatgtatccgtcacctcggcatcgtaggtgaatgtaacatccagtatgcgttcaactcagatacggacgactaccgtgtgatcgaagtaaatgctcgtctgagccgttcttccgcgctggcatccaaggctaccggttatccgctggcattcgttgccgccaagatcgcattgggttactcacttgaccagatcggtgaaatgggcactccgaactctgcataccttgctccgcaactggactactatatctgtaaaatccctcgttgggacttgacgaaattcgccggtgtatcccgcgaaatcggttcaagcatgaagtcggtaggtgaaatcatgtctatcggccgctctttcgaagaaatcatccagaaaggtcttcgtatgatcggacaaggcatgcacggttttgtcggtaatgacgatgtacacttcgacgaccttgacaaagaactttcacgtccgacagacttgcgtatcttctctatcgcacaagctatggaagaaggatattccatcgaccgcatccacgaactgactaagatcgatccttggttcctcggcaagctgaagaacattgttgactacaaggcaaaactgtctacatataataaggtggaagatattccggctgacgtgatgcgcgaagctaaaatccttggtttctctgacttccagattgcccgcttcgtactgaacccgaccggcaacatggaaaaggaaaatctggcagtacgcgctcaccgtaaagccctgggcatccttccggcagtaaaacgtatcaatacggttgcttccgaacatccggaactgactaactacctgtatatgacttatgcagtagaaggttatgatgtaaactattataagaatgagaaatcagtagtcgtactgggttcgggcgcttaccgcatcggtagttcggttgaatttgactggtgctcggtgaacgccgttcagactgcccgcaaactgggttacaagtctatcatgatcaactacaaccccgaaacggtttctactgactacgatatgtgcgaccgtctgtacttcgacgaactctctttcgaacgtgtacttgacgtgatcgaccttgaacaaccgcgcggtgtgatcgtatccgtaggcggacagattccgaacaatctggctatgaagttgtatcgccagtcagttcctgtactgggtacttctccggtttccatcgaccgtgccgaaaaccgtaacaagttctcggcaatgctcgaccagcttggcatcgaccagccggcttggatggaactgaccagccttgaagaagtgaagggatttgtagaaaaagtaggttatccggtattggttcgtccttcttacgtactctcgggtgcggctatgaacgtttgctacgatgacgaagagctggaaaacttcctgaagatggctgccgaagtatctaaagaatatccggtagttgtttctcagttccttgagaatacaaaggaaattgagttcgacgcggtagctcagaacggtgaagtggttgaatacgctatttccgagcacgtagagtttgccggtgtacactccggcgacgctacactggtattcccggcacagaaaatttactttgcaactgcccgccgcatcaagaagatcagccgtcagattgctaaagaactgaatatctccggtccgttcaacatccagttccttgcccgcaacaacgaggtgaaggtaattgaatgtaacttgcgtgcttcccgtagcttcccgttcgtatctaaggtgctgaaacgcaactttatcgaaacagctacccgcatcatgctggatgctccgtacagccagccggacaagactgcgttcgacatcgactggatcggtgtgaaagcttctcagttctctttctcccgtcttcacaaggctgaccctgttttgggcgtggatatgtcttctaccggtgaagttggctgtatcggcgatgacttctctgaagcattgctgaacgcaatgatcgctacaggattcaagattccggaaaaggcggtgatgttctcttccggtgctatgaagtctaaagtagatttgctggatgcgagccgtatgctgtttgccaagggatatcagatttatgctactgccggaacggctgcattcctgaatgctcacggtgtagaaacaactccggtttactggccggatgaaaaaccgggtgctgagaacaacgtgatgaagatgatcgctgaccataagttcgatttgatcgtcaacattccgaagaaccacagcaaacgtgaattgacgaatggttaccgtatccgtcgtggtgctatcgaccataacattccgttgatcaccaatgcccgtctggcaagtgctttcatcgaagcattctgtgaactgaaactgagtgatattcagattaagagctggcaggaatataaataaactgctttagctgtatatatattaaggagactccctctttggcatgccaagggggagtctcttcttttgtaggtatgactcttctttttgtttgttgtctgcggtgtaatgagtcgtaagatagcgctaatgttctcttcagctccttatatacttgctttttcctataaggaaagtaggaatagagtgccgttctttttagctcttcacggccgtgaacagggctgctcatggccgtgatcaactcttgtcacgaccgtgagcaatgcttgccacggccgtgaacaactaaagagatcggtgtcttaatggaacaataaaggcactataagagaaagataccggtagtatacggtatttgttgcataggatcaggattcggatgaagtaggcctgatgggggagatagcagtaggtgagatgaacagtgagatcggaagggaggtgacaataaaatgtatgaatgcggctattgtcaccatattatcaccgcttattatcaccaatgatgtgtttataatcagttagttaacttcgaaaagtgataagtgacaataaaaagcgagttcttgcttagtgaagaaacgtttgtgtagctttatggttatacaggtttgaattgattcataaccatacaggaaacgagctaaattaaaagtcggtagtatcttaaatctcctccttcgggaaggaggagtacccgcagggggaggtggtaggtgaatacgcaattctttcattcataataaattaggcacaccttgttttacctaccaccccgccctttgggcacccctccttcccgaagggaggggaatccatgcggatagctagcttaaccccagcggatagctggttcgaaactgtgcataaatgaaatgaatgattgtgcttcttccagaagcggattacacagattgatacggtttttggtagattgtaccgctaaaaaaatgtgaaatctgtgtaatccgtatctgaatcttatggtttgcttacgcaataattgtatactttcagattctgtaccttactattaaagtttcctgctttctccagcgggaaaaccagtgtacgtacataattcatcgaatcttttcccgcattaaagtaaagtttctgcgtattcatttcatcgaccactttaccgttgactctcagcgttgtactgcaattgtctccttctatctgaatcgttgctttttctcccggattcactttgtaggggaaggtattcagatagccgtcgcgtgcaaatcccatcatcccccgaatagggtctgacagatagaatacggcgttaggcgaacggaataattcggttccttcactttcttttgctccggtaatgtcgaaactaaccgtgtaattatagccaatttccggataatcggaagtgctgccgggagcgactgtggaacgttcgtataccaattccggctttttgccgattcttgccagttggttgactccgggcgcttcgctgaggagggcacgtttctcattgaatgtttcataaggaatacccgtctgagcgcctgtccacatctttacagagagtgtttgcaggggcgagaatatacggtgatggatgtctttcaccgaaataccattgccgacatggtcgttccagatggcaaacataccgccgagaatggaaggatgcttctcgtcgaatacagctttgccgatatgggcgggtgtccattccttatataagtatggttcgttgaggtaatcataatagtagccggctttcggaacgatatataccagtccgtccggaatactgatcagttgatatccgtctttgatcatagttgccggatcggcgtatccattgtaccaagcattcatgacgacattttctgatttgacgggcgtatcgcctttggcatggctgagcgcaccccatacgactgcttgcttgccgaaaccttccacaaaacggatgtaatggtcggtgaaagcacggaatttttctaccacgtctttcttcgcattcgagtattcgtctgtaccgatatgtacacgcttacctacgaataccggattgtcgccttccagatattctttgaacagagcatctacgaattcgtaagtttccggcttgaacaagtcgaggtgatccatgccgtactccttgcttccgatttccggtttgtaatgggtgagtgccagtgagtgggcgggaacgtcaatttccggaatgatttccacgaagttggatgccgcctgtttctggaagtcgatgaattctttcttggagtacgagccgtcacgggctgtcaatcccggataagtctccgattccagtcggaaggcagcgtaagtcttgtcccagttgtgctcgaagtattgcttgaatccgttatcgttcagatggacttgcagggtgttcattttgtagtaagccatgattttcaccaagtcctgcagataagccatcggaatgaatttacggccacagtctatcatgaaaccgcgaagcggataatcgggataatcacgaatcgttccttgcgggagtgagcgttcctggttttgttccgccagttgcaggagtgtgcgtgtgctccagtaaagaccggtcggggtgggagcggagatggctacacggtcggttatcttgatggcgtaaccttcctcgccgagcttcttgtctgccgacaaggataggacgaaatcgccggacgtggctttgccttgcgctacgcttaatgtctgcccgaacatctgttgataatcgtcggcaaacatccgggctattctcagtaattcgggattttgggaagtgcagacgattcgggtgtcttttcccggggtgaagttaccgtcttttcccgtccattgtttgagttcggggacaacaaacggtttcgggttgacagcggcacgggttaagctacccgtcagacaaaagatgaccaataaggccagagctttcaaagatacaaacttgtttctcataagggggattcttgtgtttttgttaattaataaatgattatagttaattattggctgaaagtaggcataatttggatatctgtcaacaagtgaagctatttattttttatttttgtgtttttcaaaatgattaaacccgattcagaatgttagtacttctatcttgtgccaagacgatgagtgcggtgtcgaaggtgaaagtccctttgaccacgagtccccgttttcagaaggaagcggcggaaatagcgttacagatgtcccagttttctgtagacgaattagaacgtctgctgcgtgtaaacgcaaagattgctgtggagaattataaacgttatcaggcttttcatgcggaagccactccggaattgcctgctttgctggcatataccggtattgtattcaaacggctgaatccgaaggacttctctgcagaagatttcgggtatgcgcaggaacatttgcggctgacttctttctgttacggtctgttgcgtcctttggacgtgattcgtgcttatcggctggagggggatgtcgtattgccggaattggggaatcagactttgttttcttattggcggtcgcgtctgacggatacgttcatagaggacatccgatcggcaggaggaatcttgtgtaatcttgccagtgacgagatgaaaagcctgtttgactggaagcgggtggagagcgaagtccgtgtggtcactcccgaatttcatgtctggaagaatggaaagctggctacgatagtggtgtataccaagatgtcccgtggcgagatgacacgtttcatattgaaaaataagatcggaaatccggaggaactgaaaggattctcgtgggaagggttcgagtttgacgaatcgctttcggatgaaaggaaattggtatttattaatgggatgggagaataaggaatatgacagaagtagagaagatgcgtagcagccagttggctgatatgtccgcgccggagttgcaggtgcgttttgagcatgccaagaagttgctggcgatcatgcgcgggttgagcacgtacgatgacgggtacagagaattgttggaagaactggtgccgggtattcctgaaacttcggtgatctgtcctcctttccattgcgatcacggagacgggataaagttgggcgaacacgtgtttgtcaatgccaactgtacttttctggacggagggtatatcacaatcggtgcccatacgctagtcggtccttgcgtacagatttatacaccgcatcatccgatgaattatctggagcgtcgcggttcgaaagagtatgcttatccggttacgatcggcgaggattgctggattggcggcggtgctgtcatttgtcccggtgtgacgattggcaaccgttgtgtgataggagcgggaagcgtcgtgacgaaagatattcctgacgacagtgttgcagtcgggaatccggcgcgccttatccgtaagcaggcttgaccgggaatcttatttcccggatttgagtgttcccacattgttggctttatcttgttctgtttagtggacaggcttggagaagggaaagttgcatgaaaaaaacttttttcattatttgctgataatcagttggtttttatttttgataaaaagtttcttgaaaaataatatgcaaaatgtttggaggtttcaaaaaaagccgtacctttgcatcgcttttgaaacggaagtgtacgggcgcttagctcagctggttcagagcatctggtttacacccagagggtcgggggttcgaatccctcagcgcccacaaagaataccgaaacacttccgtcaacaaaagggcgcttagctcagctggttcagagcatctggtttacacccagagggtcgggggttcgaatccctcagcgcccacgaaatagaagtcttacgaagaaattcgtgagactttttttatttcttaccgcttttatacaaactttctttatccttttgccttataactcaggaaaaagagttaattttgcagtctgataattatctaagaaaacgtatggaacttgatgtattaacggccatatctccgattgatggtcgatatagaggcaaaactaaagctttggcagcttatttctctgaatttgcactgattaaataccgtgtacaggtagaggtggaatactttatcaccttgtgcgaacttcctttgccgcagttgaaaggaatcgatagcagcgtgtttgaaactttacggaatatctaccgtaacttctcggaagcagatgcgcaacgcattaaagatatcgaaagtgtaaccaaccatgatgtaaaagccgtagaatatttcctgaaagaagaattcgataagctgggtggaatggatgactataaagaattcattcacttcggattgacttctcaagacattaataatacgtctgtgcctctttctatcaaggaagctttggataaagtctattatccgctgatcgaagaactgattgcacaactgaaaacgtatgcaacagaatgggctgaaatcccgatgcttgccaaaactcatgggcaaccggcttctccgactcgtttgggtaaggaagtgatggtattcgtttaccgcctggaacgtcagctggctatgctgaaagcatgtccgatcactgcaaaattcggtggcgctaccggaaattacaatgctcatcatgtagcatatcctcaatatgactggaaacaattcggtaatcggtttgttgcagagaaactgggactggagcgcgaagaatataccactcagatttcgaactacgataacttgtctgctgtctttgacgcgatgaaacgtatcaacaccataatggtggatatgaaccgtgacttctggcagtatatttctatggaatacttcaagcagaagatcaaagccggtgaggtaggatcaagcgcgatgccgcataaagtgaatccgatcgactttgaaaatgcggaaggtaatttgggtatcgcaacttctattctggaacacctggctgtgaaactgcctgtttcccgtttgcagcgtgacctgacagactctacggtgctccgtaatgtaggcgtgcctttcggtcatatcgtgattgctattcagagttcactgaaaggacttcgcaaactgttgctgaacgaaccggctatttaccgtgatttggacaactgctggagcgtagtggctgaggcaatccagacgattttacgccgcgaggcttacccgcgtccgtatgaagcattgaaagctttgacccggaccaaccaggctattacagaaagttctattaaagagtttatcgaaggcttgaacgtaagcgaagatattaaaaaagagttaagagcaattactccgcatacatatacgggactttaattgtttacttatacaataaacgtgtttttttaataggccgtgaggccaaagtctaattttattcgaataaaaaaatgagcacagaaaacgaagaatggcgcgaaaattcttacaatgaggagaatacaggtgccggccgtgatggtaacaagtcttacaacagagaaggtggagaacgtccgtatcgtccttcttacaaccgtgaaggtggggatcgtccgtatcgcccgcgatttaatccgaatagtgaaggtggagagcgcccacagcgttcttatggtgaacgttcttatgatcgcccccaacgtccttcttacaatcgtgaaggtggagaccgtccgtatcgtcctcgcttcaatagcaacaatgaaggaggcgaacgtccgcaacgtccttacaaccgcgaaggtggtgaacaacgttcttatgatcgtcctcaacgcccttcttacaaccgtgaaggtggagaccgtccgtatcgtccgagatttaatccgaacggcgaaggtggcgatcgtccgcagcgtccttacaatcgtgaaggtggcgagcaacgctcttatggcgaccgtccgtaccgtccccgttttaacagtggcgaaggtggcgaccgtcctcagcgtccttataaccgcgaaggtggtgatcgtccatatcgtccccgcttcaacagtggtgaaggtggtggctaccgtaataacaacggtggtggctatcgtccgagatttaacaatgaccgttcgcagggtggctatcgtccgcgtccgcgtaccagtgattacgatccgaatgctaagtatagcatcaagaagcagattgagtacaaggaacagtttgttgatccgaacgaaccgattcgtctgaataagttcttggctaatgccggtgtttgctcacgtcgcgaagctgatgagtttatcacagcaggtgtggtttctgtaaacggtgaagtagtaactgaattgggtacaaagatcaaacgctcggatgtggtgaagttccacgatgaaccggtaagcatcgaacgtaaggtatacgtactgttgaataagccgaaagatacggttactacatcggatgatccgcaggaacgccgcacggtaatggatctggtaaaaggcgcttgcaacgaacgcatttatccggtagggcgtcttgaccgcaacacgactggtgtacttctgttgacaaatgacggtgacctggcttccaagctgacacacccgaaattcttgaaaaagaaaatatatcatgttcatctggacaagaacctgacaaaagcagatatggatcagattgcagccggcgtacagttggaagacggtgaaatccatgcagatgctatcagctacacagatgatttcaagaaagaccaggtaggtatcgagattcactccggcaagaaccgtatcgttcgccgtattttcgaatcactgggatataaagtagtaaaactcgaccgtgtattctttgccggactgaccaaaaaaggtctgcgccgcggagactggcgttacctgtcggaagcagaagtaaactacctccgcatggggtcgtttgagtaatatataatattgtattaaaaaagttttatggaaaagattggtagaacaaaaattgttgatctgttgaagcgcgaagatattggcgctatggtcaatgtgaaaggatgggttcgcacccgcagaggtagcaaacaagttaactttatcgcactgaatgacggttctacaataaataatgtgcagatcgtagtagatctggctaatttcgatgaagagatgctgaaactgattactaccggggcttgtattagcgtgaacggagtaatggtggaatctgtgggttccggtcagaaggtggaagtgcaggctaaagaaatcgaagtgctgggtacttgcgacaatacatatccattgcagaaaaaaggtcactccatggaattcttgcgcgagatcgctcacttgcgtccgcgtaccaatacctttggtgcagtgttccgcattcgtcacaacatggcgattgctattcacaagtttttccatgaaaagggatttttctatttccatacaccgattattacaggttccgactgtgaaggtgccggacagatgtttcaggtaactaccatgaatctgtatgacttgaagaaagacgaaagaggttctatctcttatgatgacgacttcttcggcaagcaggcaagtttgacagtatccggtcagttggaaggtgaattggctgccactgctttgggcgctatctacacattcggtcctactttccgtgccgaaaactccaatactccccgccatttggcagagttctggatgattgagccggaagttgcgttcaacgacattgccgataatatggacctggcagaagagtttatcaaatattgtgtgaaatgggcgttggataactgtgcggatgatgtgaagttcctgaacgatatgttcgataagggcttgattgaacgtctgcaaggtgtattgaaggatgatttcgttcgtttgccttatacggatggtatcaagattctggaagatgccgttgcgaaaggtcacaagttcgaattccctgtttactggggggtagacttggcttccgagcacgaacgttatctggtggaagaacacttcaaacgtccggtgattctgactgattatccgaaggaaatcaaagccttctatatgaagcagaacgaggatgggaagacagtacgtgcaatggacgttcttttcccgaagatcggtgagatcattggtggttctgaacgtgaagcggattataacaagttgatgactcgtattgaagaaatgcatatcccgatgaaggatatgtggtggtatctggatacccgtaagttcggtacttgtcctcactccggtttcggactcggttttgaacgtctgttgctgtttgtaacaggtatgtcaaatatccgtgacgtgataccgttcccgcgtacaccgagaaatgctgatttctaatatttcggtatatttatgtaaaactcgcataatcttttgattgtgcgagtttttttatgcatttgattgttactttctcaaaataaatctttatatttggacatgcgcattcaagagtgttaactaaaatcatattgtcatgaaaaaactctatttctttaccatgctttcaatcatgttgttagcggtaacaggtgcgacggcccaaaagaaaaccaaattcaaaccggccgatttgaaagggatctggcagttgtgccattatgtatcagaatctcccgatgttccgggatcgttgaaacccagtaatacatttaaggtattgagtgatgacggcagaatcgtgaattttaccattattcccggttctgatgcgattatcacaggatatggtacatataaacagttgaccgatgattcttataaggagagtatcgagaagaatatccaccttccgatgctcgataatcaggataatattctggagtttgaaataaaggataatgattatttgcatttgaaatacttcatcaagaatgatctgaacggaaacgaactgaatgcctggtattatgagacctggaaacgggtggagatgccggctaagtttccggaagatattgtgcgataaatgagattgcaatatagattctttgttgttttttgacctccccggtgtaaatccggaggaggcctttttattttctgttccttatttgtaaatatagtaagttccccttgtcatacaacccgataaatccaaaaaaaactggaaatagtttgccaattcaaagaaaagccgtacttttgcaagccgattattatcacaaaatgataagagattaattcatagcaagttagtcctcctttgtccggggaaggctgatatgtggtgaagaaaatttttagtagtaacatttaaaaaacaaaattagagtggatactttaagttacaagaccatttctgcaaacaaagcgaccgtaaccaaagaatgggttatcgttgacgctacagaccaaactttaggtcgtctgggagcaaaagttgcaaaattgctgagaggaaagtacaaaccaaactttactcctcacgtagactgcggtgataacgttattatcatcaatgcagacaaagtaaaactgactggtaacaaatggaatgacagagtatatttgtcatatacaggctaccctggtggtcagagagaaatgactcctgcccgtttgatcactaaaccgaacggtgaagagagattactgaaaaaagtagtgaaaggtatgcttcctaagaatatcctgggagctaaattgctgggtaacctgtatgtatacgctggtagcgaacacaaacatgaagctcagagcccgaaaatgattgatattaattcatataaataagatataatggaagtagtaaatgcattaggcagacgtaaacgtgcaattgcacgtgtattcgtaagcgaaggtacaggaaagattactattaacaagagagaccttgcagagtactttccatcaactatacttcagtatgttgtaaaacaaccattgaacaagctgggtgctgctgagaagtatgacatcaaagtaaacttgtgtggtggtggcttcactggccagtctcaggcattgcgtttggcaatcgctcgcgcattggttaagatgaacgctgaagataaggctgcacttcgtgctgaaggcttcatgactcgtgacccacgttctgtagagcgtaagaaaccgggacagccgaaagctcgtagaagattccagttcagcaagcgttaatgtgctgcctgaccgaggaatatgtttagtatctaaactactgggactctgctcatagactacccagcggttggtttagaaaaaacaaaaaagaaagtaaacgatttaaagaaaaaacaagatgtcaagaacaaattttgatactttattggaagccggttgccacttcggacaccttaagagaaagtggaaccctgcaatggctccttatattttcatggaacgcaatggtattcacatcattgacctccacaaaacagttgcaaaagtagacgaagctgctgaagctttgaaacagattgccaaatcaggcaagaaagttctttttgttgctactaaaaaacaagcaaagcaggttgtagctgagaaagctcagtctgttaatatgccttatgtaatcgagcgctggccgggtggtatgttgaccaacttcccgactatccgtaaggctgtgaagaagatggctactatcgataaattgactaacgatggtacatattctaacctttctaagagagaagttcttcagatctctcgtcaacgtgcaaaattggacaagactttgggttctatcgctgacttgactcgtctgccgtctgcattgttcgttatcgacgtaatgaaagaaaatatcgcagttcgtgaagctaaccgtctgggtatccctgtattcggtatcgttgatactaactctgatcctacaaacgttgacttcgtaattcctgctaacgatgacgctactaaatcagtagaagttatcctggatgcttgctgtgctgcaatgatcgaaggtttggaagaaagaaaagctgaaaagatcgatatggaagctgctggtgaagctcctgcaaacaaaggcaagaagaaatcagtaaaagcaagactcgacaagtctgatgaagaagctatcaatgcagcgaaagctgctgccttcatcaaggaagacgaagaggcttaaatatataaatgtgccaatttgctagcgtgcaggcgtgtggtagttacctcatcctgcattgtattggcagattggcacattttttgttttgaaaattattattcatttaaataaaggaaattattatggctgtaactatggctgatattaccaagctgcgcaaaatgaccggagctggtatgatggattgcaagaatgcattaacagaagctgaaggcgattacgacaaggcaatggaaattatccgtaagaaaggacaagctgttgctgctaagcgttcagaacgtgatgcttctgaaggttgcgttttggctaagactaccggtgactatgccgttgtcattgctctgaagtgtgaaactgactttgtggctcagaatgctgattttgtgaaactgactcaggatattcttgatcttgctgtggctaacaaatgcaagacattggacgaagtaaaagctttgccgatgggtaacggtactgtacaggatgcagtggttgaccgtagcggtatcacaggtgagaaaatggagcttgatggttacatgactgtagaaggaacaagcactgctgtttacaatcacatgaacagaaacggtctttgcaccattgttgcttttaacaagaacgttgacgaccagttggctaagcaagtagctatgcagattgctgccatgaatccgattgctattgatgaagatggcgtttctgaagaagtaaaggaaaaggaaattgctgttgctatcgagaaaacaaaagctgaacaggtacagaaagctgtagaagctgctttgaagaaagctaacatcaaccctgctcatgtagatagcgaagagcacatggaaagcaatatggctaagggctggattacagctgaagatatagctaaggcaaaggaaattattgctaccgtttctgctgaaaaggctgcacatctgccggaacaaatgattcagaacatcgctaagggtcgtctgggcaagttcttgaaagaagtttgtctgctgaatcaggaagatattatggacgctaagaagactgtaagagaagtattggcagctgctgatcctgaactgaaggttcttgactttaagcgcttcactctgaaagctgaataatttatctcaaaaagataatagagaagggcggaactttgatggtttccgccctttttcattatcctccgacccctttggtctttgtatatccttcttttatcagcaggtctatcactttctgcttgaaatctccctgtacgatgatttctccgtctttggccgaacctccgactccgcatttactttttagcatttttccgagttctttttggtcattctctgttccaacgaatccggtgatgagtgtaactactttgccgccacggttttttcggtcgagagaaacccgaaggttctgtttgctcttgtccagcgtcacttgttcctgatcgtcatccatgtcatagttgaaatcaggatttgtagagtagaccacgttcaatctatctttccaatcattatttttcatatacttcaacttttattgtgtcaaaagtaatattttgtggggaactttgcaatcttttgtttactttggcgtctaataataaaacgaaataagactaataaacagaaaatgatgaaacaatccatagcgtttgctctcatatgttcttttactatttctctttgggcacaaacatttaaaggcagagtagttgatcttgcaggaaatccgatcccctatgcggcactctatctgaaagaacttaaaacaggcttcactaccgatgataacggctgttttcagacctcgctcccggcgggacaatatacctgtgaggtttcttctttaggtttcgccggacaaacattctccttttccatatctgccggagatgtggaaaagaatattgtgctctccgaacaaatatatagtctgcgggaagtgaatgtggtgaaaggtgtggaagatccggcctattccgtaatgcgtaaggcgattgcgaatgctccttattaccggacacaggtgaagggatttagagccggcacctatctgaaaggcacgggaaaaatgaagactattcccgcaattctaaagctgtcgaaggaagtcagaaaagagtcgaaagagtttcctgatgggcaaaacctatcgtacttcagacaagaaagcatggattggctggaaaggcttgccttcctatgtgtctgagtataattttgtggatggcttctggctgggagctaagtttgaaacagggttgaagctatcggaggcatctactttgcgattcactccttctgcttattataccactgcccgtaaagcggtagcagggcaaagtgaactctccttgagttatgctccgaggcgacggggatatctggaactgtccggcggagttctttctgccgattataatggagaaagtggagaatcccgtctgataaataccgttgcctcttctttcttcgggcggaatgatgtgaaactctatgagaagcgtttcctgtctttccaaaataagatcgaactggcgaatagtttgttgctttctacctcgctttcctggcagcgacgacagatgctggagaatcatatacaccggagctggttcaagaaagaagcggagtcgaatattccggacagccgggcattctatccgatgccggaaaatgaattattgaaagcttcctttgccttggaatatacaccggctcattattaccggatgtacagaggaaagaaagtatatgaagaatccaaatgccctacctttacattgcgttatgaccgtgctttcccgttgaaaggggctttgccttctccgtcctatcacttggcggagttttcggccaggcagagcatagagttcggaatgtttaatacactagactgggctgttaatgccggaacattctggaataagagcggtatgcaattccccgatttcaagcattttgcgaccacaggtttgccggtgacggaacgctcgtttgatacaggattctctttgctggataattatgcatactctaccaatacccgttgggtacaagctaatatttcctggtacacaccctgtctgttgctgaaatttcttccttttctgaaaaagaagaacctcgatgaagcgctgcatctccgtacacttgtggaatacgaccgccgtccctattcggaaatcggttactccatcggattcatgaaactggcacggttaggcgtcttccttggcttcgacagtttgaaataccgctcggcgggagtttccgtcagcattccgttgtcaacgtttgcgggagaatagcacctgtgtagaaatagtatgaatcattcttgcaattccgaaaaaaaacgtatttttgtcaatcttataacctgaataaataaaagaaatggccgagaaccaaaagatacagcagatagattgtacgaaagtgccggagcctactttgcgcagactgccttggtacttgtcgaatgtcaagttgctgaagcaaagaggcgaacgttttgtctcttctacgcagatatctaaggaaataaatattgacgcttcacagatagcaaaagacttgtcgtatgtgaatatctccgggcgtacacgtgtagggtacgaggtcgatgcgctcattgaggttttagagcacttcctggggtttacggagatacataaggcttttctttttggagtcggcagtctgggaggcgcacttttgcaggactccggtctgaagcatttcgggcttgagattgtggctgcttttgatgtagacccgactttggtcggcactaacctcaacgggattcctatctaccattcggacgactttctgaagaagatggaagaatatgacgtgcagattggcgtgctgaccgttcctatcgagattgcccagtgcatcacagatatgatggtggacgggggaatcaaggcagtctggaactttaccccgttccgtatccgtgtacctgaggacatcgtggtacagaatacatccctttacgctcatctggcggtgatgttcaaccgccttaattttaatgaaatcaaataatgaagattattgccgtaggaatgaactatgccctgcacaatcaggagctgggacatacatccgtaaataaagaaccggttattttcatgaagcccgattcggctattctgaaagatggcaaaccgttctttatccccgatttttcgaatgaagtacattatgagacggagcttgtagtacgcatcaaccgtttgggaaagaatatttctccccgttttgccagtcgttattatgatgcattgacggtaggcattgactttaccgcccgtgacctgcaacggaaattccgcgaagcgggcaatccgtgggaactttgcaaaggtttcgactcttctgccgctatcggcacctttgttccggtagaccgctacaaagatatccagtctctgaatttcaatctgatgattgacggcaaggaagtgcagcgcggctgtacagccgatatgcttttcaaagttgatgacatcattgcctacgtcagtaagtttgtgactttgaagattggcgatttactatttacgggcacgcctgccggagtagggccggtcagtatcggtcagcacttgcagggatatcttgaaggagaaaagctgcttgacttctacatacgttgacccgtgtattctttatttgactcatttattaaatagcttatgaaaataagaataggttttggcttcgacgtacatcagttggtcgaaggtcgtgaattgtggctgggcggtatccgtctggaacattccaaagggttgttgggacattcggatgctgacgtattgctgcatacggtttgcgatgccttgttgggagccgccaatatgcgcgatatcggttatcattttccggatactgccggagagtacaagaatatcgacagcaagattcttttgaaaaagacagtggaactgattgcgaccaaaggataccgtgtcgggaatatcgatgcgactatttgcgcggagcgtcccaaactgaaagcccatatccctttgatgcaggaaacgatggcagccgtcatgggaatcgatgcggaagatatctcgatcaaggcaactacgacggagaaactcggttttaccggacgggaagaaggcatttccgcttatgctactgtgttgatagagaaggactgacaaagcagattactaacccccttaaacaataaatagtatgaatcgaactttaaaattattcttagcactggtctctttgtgtatgaccgtcttctgcttcgcccaaaagagcgaattacgcttcaataaagacggtaaatttaaaatcgtacagttcaccgacgtccatttcaagtataagaatcccgcttccgacatcgcattggaacgtattaatcaggtactcgacgaagaacaacctgattttgtaatcttcaccggagatgtcgtttattctgctccggcagataaaggtatgttgcaggtgctggaacaggtatcgaagcgtaagctgccgtttgttgtcactttcggcaatcatgataatgaacagggaatgacgcgggaacagctatatgacatcatccgtcaggtacccggcaatctgatgccggatcgtggctcggtcctttctccggattatgtcttgaccgtgaaagcctcttccgatgcgaagaaggatgcagccgtcctgtattgcatggactctcattcttactccccgctgaaggatgtgaaaggttacgcatggctcacgttcgatcaggtcaactggtatcgtcagcagagcgcagcctatacagcacagaacggcgggaagccattgccggcacttgctttcttccacattcctgtgccggaatacaatgaagcagcttccgacgaaaatgccatcctgcgcggaacccgcatggaagaagcctgtgctccgaaactgaatacaggcatgtttgctgccatgaaagagtccggagatgtgatgggaatattcgtgggacatgatcatgacaatgattatgcagtgatgtggaaaggaatcctgttggcttacggtcgtttcacaggcggaaatacagaatacaatcacctgccgaacggtgcccgtatcatcgtgcttgatgaaggcgcccgcacgttcacttcctggattcgtcagaaagacggtattgtcgacaaagtgacctatccggcaagtttcgtcaaagacgactggaccaagcgttaactattgccagcttcacattgctgaggcgggtatatttggaaccgtagctttcgaacaggcgtgacacccgcgccgatgctacatatataatttctcccgggcgatattcatgctctattccggatagagtgcatgataccgtactgggagtttttgatgggatgctcatcgtcaccaggttgccgctggcgtcgttcagagtcagtatctgcttgacgaaaaattgcggagtcgttccgtatactcttgttttatacggatcgtcttccaggcgtacccgcatgactttcaactttaagtccgtcagcttctcgttcacttctcctagatagcggctttttcggcgtacctctttgctcttccgcagcatcacgtccagatgtaccgaatgatatgcctgcgctattttgacgaaacgctcctgtttgggaatcttcggagtaaacttataggcgatccagcttagataggcaggatcgactttgaggatttcgtgcaggaagtgtcccctgtatttgccgaaaaagatgaggtcgtcaccgttgctctgcattctcttctcgttgtaatccatcaggatgaggcaccgtcgcgaataataaaacatggtgcttgctatccgcagggactcgttgatatccggagataaatcgtgtatatagagaatcgattgcttttcgggcaggggagagtagagccaaagggaatagttgggctttcccggtcggggcaacaccaccagataaacccctgcctctttaaaggaggctctgcctcggttgtattcattcagtttggcatacaataaggcttgctcgctttcggaaattcccggtaattttggattagccataattgttctcgcttttggtataattcaaatatactgattttctttcagaaaagcaagccttggcgggagtttcttcgaataaagcctgttggtgaagttaactcgtttccgattcagatttgaatcaaccgctgattcgcattaatagctaataaagcgaaaataaaaattaagtccgaagattattcttctcataacatcataaggtgttcagatcaatgacacaaaaagagaaaggtagtattgtagcaataattcatcgatttacctagaaaataaagaatctttcaaaatcagcacccacatctatacgaaagactttgactaattatgcggtaacagccaatcatttattaataaattctttcatcgtttattataaacgtcctccaagtttattataaactctaatttcgttattcctgcaataaacatccattttaagcaacaaaaagggctgcaattcccataaggaatcgcagcccttagcttgtatcagactatccaacaagcattacccggagtgggaatgcctgcaatctgttattatataatacttattattgctcatttttcgtctatattatcaatgttattgaatttgcttccggtttacacttacaaagatacaacattaaaagcggtttgtcaagtcctccatgcttctttcatacatctgattacaaatcatacggatttgcgccgaatgatagtcagtagtatcttgaatcatttttaaaccgttttgaataattaaagagacagtaggaaatgattgtctgatgatggcaatggggctgttgcctgttcattcattaggggacacaaacttttcatttccttttttatggctgtctgactataatcttgtacttttgtattcttctaatgattggaaattcggatgaaagaacgaaataaaagagtattggttggcatgagtggcggtatagacagtaccgctacctgtctgatgctacaagagcagggatatgaaatagtaggagtcacgatgcgtgtttggggagacgagcctcaggatgcccgcgaactggctgcacgaatgggaattgaacattatgtggctgacgagcgtataccttttaaggagaccatcgtgaagaactttatcgatgagtacaagcaaggacgtaccccgaatccgtgcgtgatgtgcaaccccttatttaaattccgtgtactggcggaatgggccgacaagctggactgcgcctacattgcgaccggacattactcccggctggaagagcggagcgggcacatctatattgtagcgggagatgatgataaaaaagatcagtcctacttcctatggcggctggggcaggatatactgaagcggtgtatcttcccgttgggcgactatacgaaaataaaggtgcgtgagtacttggcggagaaaggatatgaagctaagtctaaggaaggcgaaagtatggaagtctgtttcattcagggagattaccgtgattttctgcgcgagcaatgtccggaactggatacggagatcggtccgggatggtttgtcaactccgaaggagtgaagttgggacagcataagggagcaccttattataccatcggtcagcggaaaggactggaaattgccttgggcaagcccgcttatgtgctgaaaatcaacccgcagaagaatacagtgatgctgggagatgccgaacaactgcagacggaatatatgctggcggaacaagaccggatagtagatgagcaagaactgttctcatgcgagaatcttgcggtgagaatccgttatcgcagccgcccgataccttgtcgggtgaaacgtctcgaagacggacgcttgttggtgcgctttcgtgagacggcttcggctgttgcccccggtcagtctgccgtgttctacgatggacggcgggtacttggcggtgcgtttatcgcttcgcagcgggggatcggactggtgatcatagagaataaagacaaattgtagaataaaataaatagagagatttagatgaaaagattagtattagcggcattgatcctgactacagcggtgggagcatctgctcaatttacctctaccgataccttgaaatatcggatcagcctcacagataaggctgcaaccacttattccatccagcaaccggaggagttcctttccagaaaatccatcgaccgcaggttgagacagaagctggctatcgactctaccgacttgccggtatgcaagaagtatgtagatgccatacgaaagaaaggcgtccatgtgcttgtcaccggaaaatgggataatttcgttacagtctcctgcaatgacagtatgctgatcgatgaaatagccaaactgccttttgtccgttccaccgagaaagtgtggcagggaaaagtgtcggcagttaccaaaagagattcgctgatcaatgatccgcagcgttcggacagcctgtatgggcccgctatcactcagattgaaatgagccgagccaaccttctccacgatgccggattcaagggacagggcatgacgattgccgttatcgacgccggatttcataatgcggacagaatcgaagcgatgaagaatatccgcatactcgggacacgcgactttgtgaaccccgaagcggacatctatgccgaaagcaaccacggtatgtcagtactgtcttgtatggcaatgaatcagccgaatgtcatggtcggcaccgcaccggaagcctcctactggttgcttcgcagtgaggatgaggcttccgagcatttggtagagcaggattactgggcggcagccatcgaatttgccgatagtgtgggcgtggatgttgtgaatacctcactgggttattatacctttgacgacccgaccaagaactatcgttaccgtgacctgaacggacactatgcactgatgtcaagggaggcttcgaaggcggcagataagggtatggtcctcgtttgcagtgccggtaactctggcagcggctcatggaagaaaatcactcctccgggcgatgccgagaatgtactgactgtgggtgctattgataagaagaagttactggccccgttctcttctgtcggcaatactgccgacggacgtgtgaaaccggatgtcgtagcagtcggcctcaaggcggatatagtgggcacagacggtaatcttcgtctggccaacggaacctctttctcttctcctatcatgtgcggaatggtagcttgcctgtggcaggcctgcccgaggttgaccgccaaagaagtgatcgaactggtgcgcagcgtaggcgacagatccgattttccggacaacatctacggttatggcattccggatctctggaaagcataccaaatgagcaaagaataacgaacggtccgctattcttcgttgttaggctatatcaaattcgcatctcattatagaaatgtgtcattcatttatcgttaattatgcctatggattctctttccctactagagctaaacgcgcttgtccggcgaagtctggagcaatgcctgcccgatcaatattggatacaggcagaactgagcgatgtccgttccaacactaccggacactgctatctggagtttgtgcagaaagacccgcgcagcaacaatctcgtagccaaggcacggggtatgatctggagtaatatctaccgcttgctgaaaccttactttgaggaaactactggacagttatttgcttccggcatcaaagtcctggtgaaagtaacagtccagtttcacgaactctacggttacagtctgactgttctcgatatcgaccctgcctatacgctgggcgatatggcccgccgccgtcgtgagatactcatgcaactcgaagaagaaggagtactgactttgaataaagaattggaaatgccggttcttcctcaacgtatagcggtcatttcctctgccaccgcagccggatacggagatttctgtcatcagttgcagcacaattctggcggattctttttctataccgaactgtttccggcgttgatgcagggcaatcaggtggaagagtccgtattggctgcattggatcgcatcaatgaccgggtgaacgagtttgatgtagtggttatcatacgaggcggaggggcgacttcggatttatccggttttgatacgtacctcttggcggccgcttgtgcccagttcccgttgcccgtcatcaccggtatcggtcacgagcgggacgatacggtgctcgactctgtggcacatacccgggtgaagactccgacggctgctgccgaacttctgattcaccggatcaccgaatcggcagatcatctggaagagttatccgcccgtctgcaacaaggggcgtatgccctgctcgaacaggaaggacggaggctgggaatgattcagacccgcatcccgaaccttgttcaccgaaaacttacagatgcccgctttgccttgctggcagccggaaaagacttggcgcaagtcactcagaccctgttgtcccgtcatcgtcaccggctggaacttttgcggcaacgtgtggcggatgcttctcccgacaaactgctgagtcgtggatatagcatcacgctgaaagacggaaaagcggtcacggatgccgcttcgctgaaccccggagaccagttagtgacccgtctggctaagggaagtttcacttccgaagtccggctcgatgagcattattattcatcttaaatacaataaatatggcagctaaaaaagaaacatactctcaggcaatggagcgtcttgagaagatagtccgtcagatagacaacaacgaactggatatcgacactttgagcgaaaaaataaaagaagccaatgaaattattgccttttgcaccgagaaactgacaaaagcggatcgggaagtcgaaaaattgttgcaagaaaggcggcagtctgaataataaaagttatttttgcgaatcaaagcgtaaaataaactaatacataacgatatgaaagaaatagactgggcgaatctgtcgttcggatacatgaagacagattacaatgtgagaatcaatttccgtaacggcgcatggggcgaactggaagtcagcagtgatgaacatctcaatctgcacatggcagctacttgtctgcactatggtcaggaagcttttgaaggtttgaaggctttccgcggcaaagacggtaaagtacgtatcttccgtctggaagaaaatgcggcacgtctgcaatctacttgtcagggcattctgatggccgaactgccgaccgaacgtttcaaggaagcgattctgaaagttgtaaagctgaacgaacgtttcattccgccttatgaaaccggtgcttctctatacattcgtccgttactgatcggaacaagtgcccaggtaggcgtacatcctgccgaagaatatatgttcgtggtatttgtaactccggtaggcccttacttcaaaggtggtttctctaccaatccgtatgtgattatccgcgagttcgaccgtgccgctcctcatggaacgggtatctacaaggtaggcggtaactatgcggccagtctgcgtgccaacaagaaagcgcacgatctgggctattcctgcgagttttatctggatgcaaaagaaaagaaatatatcgacgagtgtggcgcagccaacttcttcggaattaaagataatacgtacattactccgaaatcatcttctatcctgccttcgatcaccaacaagagtctgatgcagttggcagaagatatgggcatcaaggtagaacgccgtccgataccggaagaagaactggaaacgtttgaagaagcgggcgcttgcggtacggctgcggtaatcagcccgattcagcgtattgatgacctggagaacggaaagtcatatgttatctctaaggacggcaagccgggaccggtctgcacgaaactgtataataagttgcgtggcattcagtacggtgacgaaccggatacacatggttgggtgacgattgtggaataattgatctttaagtataatctcttttaattgcgtaattactatgttgaaacaaaattcagagttgcgtgctcaagcacgtgaagcccttcgtggaaagtggcctatggcagccgttgctgctcttatttattcggctatcgccggtggtttgtcttccattccttttattggatggatcgggtctttgttggtcggactgcctgttgcatacggctttgctattttgatgctggctgtattcagaggagcggaagaggttgatctgggagtgttgtttgcaggatttcaggaatatagtcgtatcttgactactaaactgctgcaggctgtttatactttcctgtggtcattgctgttgttgattccgggtatcattaagcattattcttatgcgatgacggactatattctgaaagacgaatctgaattgtgtaacaatgctgccattgaaagaagtatggcaatgatggaaggcaacaagatgaaattgttcctgcttgatttgagcttcatcggttgggctatcctttgcctctttactttcggtatcggattcttcgttttgcaaccctacatgcaagtatctcacgctgctttctatgaagatttgaaagctcagcagggtggtattaatatcaatgtagaagtaactgtagaaaactgataagcgaataaatatcattctatagaatggagtacggagcaatctgtactccatttatttttgtagtttacgccaaaagtaagtacctttgcgtcctaatcagtaatgagatgggaaagaataaattagagaagtttgccgatatggcgagttacccgcatgtgttcgaatatccttattcggcggtggataatgtgccttttgacatgaagggaaaatggcatcaggagtttttcggaaatgatcatccgatcgtgctcgaactgggttgcggacggggtgaatataccgtcggactgggccggatgtttcccgataagaactttatagcagttgatatcaagggttccagaatgtggacaggcgccacggagtccttgcaggcaggaatgaagaatgtcgctttcctgcgtacaaatatcgagattatcgaacgcttttttgcagcaggtgaagtcagtgaaatctggctgaccttctccgatccgcagatgaaaaaggctaccaagcgtctgacctccacttacttcatggagcgctaccgtaaattcctgaaaccggatggaatcatccatctgaaaaccgacagtaactttatgttcacctatacaaagtacatgatagaagccaatcagtttcctgtcgagtttatcaccgaagatttgtatcattcggatttggtagacgatatcctgagtattaagacttactatgaacaacaatggcttgatcgtggtttaaatatcaaatatatcaagttccgccttccgcaagagggagttttgcaggaaccggatgtggaaatagaacttgatccgtaccgtagctataaccgtagcaagcggagcggactgcaaacgagcaaatgataagtaataagtgacaagtaataagtaataaatagtaattgagtggagttcttaactttccactctcaattctgaactaattatggctctttatccgaaattaatattggatgcgctggcaacggtgcgttatcccggtacgggaaagaatctggtggaagcggagatggtcgccgacaatctccgcattgatggcatggcagtcagcttttcgttgatatttgaaaagccgaccgatccgttcatgaaatcaatgttgaaggctgctgaaacagctatccatacatatgtgtcaccagatgtacaggtaactataacaacggaaagcaagcaggcagcccgtccggaagtgggcaaactgcttccgcaagtaaagaatataattggtatctcttccggtaagggaggggtaggcaaatctaccgtatctgcaaatttggcggtggctttggctaaattgggctacaaggtcggcttgcttgatgctgacattttcggtccttccatgccgaagatgtttcaggtggaagatgcccgtccgtatgcggaaaagatcaatggacgtgacttgattattccggtagagaaatacggtgtaaaactgctttctatcggtttcttcgttgatccggatcaggctacactctggcgtggcggtatggcgagcaacgcattgaagcagctgattggcgatgccgactggggggatcttgattatttcctgattgaccttcctcccggcacaagtgacattcatctgactgttgtccagacgttggcaatgacgggggcaattgttgttagtactccgcaggcggtagcgctggcggatgcccgcaagggaatcaatatgtttacgaatgataaagtgaatgtgcctattttaggactggttgagaatatggcttggtttacgcctgccgaactgccggagaataagtactatatctttggtaaggaaggagccaagaaactggcggaagaaatgaatgtgcctctgctaggtcagattcctattgtacaaagtatctgcgaaggtggggacaatggtactccggtggcgctggatgaagatacggtaaccggtcgcgctttcttgtcattggctgccagcgtagttcgtcaggtagatcgccggaatgtggagatggctccgactaagattgtagagatgcacaaataagtgctcttatttactttaaatataaaacctcccgatgatgttacttttgtctgtcatcgggaggttgttttatcttatggtatatattggtatagcttgttgctaccttgcgattggtgattctacttttccaatgctttcatcaattgttctttcatggtatccactccggggaatccggtctgtttataagtgatgtttccttctttgtcaataacaaagtaagtaggaacgccccggatactgaacttctcgcgcagatagctccactgttcatccgtcacacggaaatgttctccgtgaatgtcaggaatcatgtttctccaggttcccagcggagacgtttcacctgtgatgtaaaggtagatgatgtctttgtctttcagttcttttttcatcgggagaatctgtttgttggcagaccggcatggaccacaccaagttgcccaaaagtcaactaacagcgtatgtccccggaatttggagataatggaggggaataaatcttcattcgatacttctcctgtctcattaacggtgaatcctgttttcttcttgttgatttctatttgtttcagcaggtcgttgttcatagccagagccatgtcgttgtatgctgcgggcatcgttgccagttctgccttttgcttatcgttaagtggattgagatctctcatggagactccaatcatctgtgccttcagattttgtattaagtaactggcagctgtatgataactcaggctcttaagaatcttatcatctatacctatacggcgtatgatgtcaaacagtatcgggtatctgctgttgtaacaggctttaggtgaaaggatatacgtgaagtcctgaagactttcataatatccttgcggaatatcaatcttagtctcggcatagtatttatttgctttttctccttccagcccattcgtcatgatatgagctaatttcaagttcctttctgtttcgataatctttagtgcggcagacaattcgaggtctgtattaataatctccttatatgcagggcttcctttcgactgtgtgatttgttttctgaactcagggagtcgggcaagtatttgaactttatattcttcagctgttttaccattcagctttttaatctgttgttggtattcttcataactattgccttcagtgaaactgaaactcataggatgatctgccagctcttgctgtactccggctaaatatcctccgtaatagatttcttttccgtatggcttttctgcttgacggagatgtgactgcttgcgggcattttcgcgaagattgataacgaccgaagtggtttcccccggtgctaataagtagctgacagctccaaaaggaaacctgatcatgcatggggtgaccatgaagacattcatctcatgataaaacgttccgtcatcctggatgcggatttttccttcctgagcttcgtctcttattacatcttgaaaataaagactgcctttgttgggcatccctttttggtagtcaaggattcttcctttgagaattgctttggcgtatttaacgactggttcgggcagcgtcgttttatggtctgctttggtgactgtaacgtctttaggcagtttgaacttgctgaatgttttcttgtccagctgtatgccccatatcttatatgcaccctcaaagtctccttcagagaaatccaggcaagtcacgttttgaggaatgggggggaaggttaattgaaattcggcttcgccggactcgggcatccagaactctttgtccagcgtaatgccgattcccttccggacagggtataggttgccattgttgtctttcagtacactgccggttgcgatctttatccagtatttgggccgatagaaagctttgatatacacagtggtgactgtgtcactcatgacaattttgtctatctctatacttgaggaactctgagctaaaaagggaggacgttctacgattctgtctttagcttgtgtcatacaaagtatgcttagcagcaaacttatcattaatgcgaatcttttcatacgattaggcttttatctccaacaaatgtaatcatattattgtaattatctatgcgaaaacagaaaaaggagcagaatcgtttacgattgctccttttttctgttatttatttgttaggggaataatgatattttcggttttgcttattgaagtcggaatgtaatagggaatgtatattctacggcaacggcttgtccgttctgttttcccggttcccacttaggcataccccgcactacacgaatcgcttcagcgtccaaccatgccgacgcaccttctaatatttttatattcgacacgttaccgtcttttccgatgacaatctggaccagcacttttccttgttccttattctgctgggccatagtcggatattttatatttttggctaagtagcgcattaatccctcctgtcctccgggaaatttaggcatctcgtctacgactttgaaagttggttcattattgggtgtggcttctttaggaccatagcccaccactacgacctcttcaaacttttctattgctactgcttcgggtgtttctgccggttttgcaggttccggaccggacagacggaaagttacgggaaccgtaaatcttacgttcacagcttgtcctctttgcttgccgggtttccaattaggcatggcagcaatcactcgttcagcttccttgtcaagataggggtctacgcctcgaactgttttaacgtcggaaatgctaccgtcttttttgactacgaacatcacaatcacacgtccttgctttccattttcatgagctgttgccggatatttgatattcttggcgagatattccatcagtgctgattgtccaccggggaagtcgggcatttcttctacaacttcaaatacgacagaatcatttacagtagcacttttaacgggtgccggagggggaggaggagctacctcttttgttttctgcgttccttttttatcctgtaatgtcgctactcccgtcattccatcgggaagttccggaccattggcgagttcggtttgcgaaacaccttgttcttccggtgctgccatcatttctttggcaaattctttcgttgtacgagctactacttcgatgttgctgataatcatcaacaaggcagccaagggaaggaacatcagatatttagtccttcctatttctttggttcttcgtttattcatcattttgatacgatttttaagtggtaaaacattgaaactattagataaatttgctgcagccttgtgatgtgccagtcccagcaagtggtactggtatgatttactatcatgtcccgtctctaatacccggtgatctgccatgtattccagattacctctgacttcccgtttcatcagccagacgaagggattgaaccagcagaaagtacacatgatctcactgacgagtacatctgctgagtgatattggcgggcatgagtctcttcatgcgtgattatttcgctgatctcagattctgtatgcgattccggatgtatgaatatccagtggaagaaggaaaagggtcctgtacctttcttcaatatgtgtacacgtgatccttgtatcgtgcttttcgggcataggaaatgcaatcgtatgatactgcccagctggatcaggaagcgtagggtaagaagtaatacaccggtccagtagataaatcccagaatttgtgggattagctcctgccaattggccgttgtttcctgtggtgcctcgatgatttgctccggaagtatgatcgtagcataaagatctgccattgccaccatcggctcctgctcctttatccactcttgaatattcagtaagggatagagcagagagatgccaaagaagcataacagagcggtccgtcgccagtggaagaaggtgtctttatgaaaaaacaaccgatagaaagcgtagaacaatgcgatggctacgtttatctttaagaaataggcaagttccggagtcatatcgataaagtttcagtttatttttcttttcctttctctatcaggtcgataatgtccttaaggtcatccgtagatatcttctggtcctttgcaaagaaagaaaccatttccttataggagttctcgaaatagttgcggacaactccactcatgaagtggcgtttgtattcattttcacgaatagagggagtatactggtaggtgttccctatatgtttcgatttaacgtatcctttccgttcgagatttttcacgatggacgcaacggtggtataaggtggtgccggttgcggaaacttggatacgatgtcctttacgaaacagtcttgtaactcccaaatgtagatcattacttcttcttcttgtatagttaacttttccatggagatgatgtttaattacgattctttcgcaaaactacgaatgtttcgtaattaagcaatagctagtcggttaaatattgtaaatgcccgtttgaaataggatgattggcgggtaaaagccccttctcgtaagcatgaaaataatgtggataaacgttattttcatccaaataagcaatctttaggacatttaggtgaacaaaatgcctttcgtggcttttttatataaaataaatgaaatacttttgtagagtataaaacgtatgttaataaaaggagagtgcgtttcagcacaaggcaaagcttgaaagattccccgtactcgataatgaagctattaactatgcagcccggagggaagagggaggcaaactaaaaaatgactgatatgaaaaaaggtttgatttttgtgctgtttgcacttgtttctatcgtttcttattctcagatttcctggaatgctaaggtaggtatgaacatgagtaatttcacaggagacgctgatacggacatgagagtaggttttaatgttggagtgggaatggagtatcagtttactgatatgtggtctattcagccttcattgatgtttactcagaaaggtgctaaactgggtgatatcaaggctaatccgatgtatctggaactgccggtaatggctgctgcaagatttgctgtggtagacggacaaaatgtagttgtaaaagccggtccgtatttggcatgcggtattgccggtaaatacaagatagctggcgttaaggaagatttctttggtgacaacggcggaggtaaaagatttgacttcggacttggagtgggtgttgcttatgaaattaacagattctttgtcgacctgaccggagaatttggtttgactaaagtgtatgatgccagtggctctcctaagaacatcaacttctctatcggagtaggttacaaattctaattgaattatattctctttataataccattcataaagtcctctgcccaatagatggagcgggggactttttcatttcctcccataaagaaatttctcttcctataaagaaaaacgatgtatacttccgaagaagcacacatcgtactaaactctctctcttaattgtctcaatcggtcatctgtttggccagattctctttttctttcagttctttatatctctctatggcgtgtttccggctcatcagtatttgccagcggtatacccagcaagtggtgaggaaataaacgcctgcttgtatccacaatgccttgtattcaaaggcgacttcgcttaaggtagctcccatattattgatcttcacaaagccattgatgccgaatgtggacgggaaaatgtaagaaacatatttccagaacggaggaatggcggctcccggccacgagataccggaaataaacagcagcggtacggaagtgaatacaaaaatcagcatacaggtttcccggttgcgaatggcgatggaggtggtcattgcaaagaaaatgcaggctgccagatagggggcgacaaataataccagtgaaccgggttgcccgatttggttgaggctgaatagtcttggcacgatatgcagcacgtaaaatgataccagtacgtacacaaggaagtaacttagccccttgccaagtacaattcgcaacgttccgttataatgccggttgatggggacaaggtctttaaaccggttgttttcccgggcagttcctgctgccagtccgattccgagcaatagcgtttgctgtatgatcagcaccaatacggcaggaatcaggaaagcggcaaaaccggctgtaggattaaagatggaaatctcttcatattctatcggataaccggtgatttcgtcctgtcgctcggtcgtgttcccgctacgcgcgatctttatatctttattcatatccagtgatacggccgtattggcgatcagcatggatttatagtacagcaatccgctcatgtcgcaatagatgctgacttgcgtctgtttccctttggcgatgttgtcgctgaaatcagatgggatatagatgatgccgtatgcaagccggttcttcagcatttgcttggcttcttccatatcggcacaataggcaacaatctgaatgtccggtgtggcatccaccttccggagatattcgcggctcagggatgaatgagagtcatcgactacaacggccggaacttctcgtactacttcattgtcatagataaagctgtacagtaacggatagcccagtgggacgaggataaagaaaatcagtaccccctggtcgcggaaagttgtctgaaactcgcgcttccagatataaaacaggtcgttgatgccttgggctatcttgtctttaaattttatatctttcatcagggtatgtatttatagtaaaccaatgcttctttcaagcggtgaaccacaaagaagggaagcatcatgaatattaataatgccatatagttggaccatgagtaagccatgctgtatccgttgagcgcctgatctacataaatcaggaaataatgacgtaacggaaacaggttgctcaaggcctgcaaaacaggattcattgccatcaccggaaaagaaaaaccggagatggagaatgaaatcactccccacaaggaggcaaaacttaatccgaggcggagtgtaggcagtgtacctatcatgacgatgccgcaacactgggatgccaatacaaggcagagcgtggcgaatatcatcgggaagatgccactgttgcaggggaaatgcagaaaaccgtacaggtatacattatagaatatccccattatgaaaaagaccaccgtatgcggaagcagtttgcctgccaaagcaatgtaaatggaattgttactcattcgcaaccattcacgggcagtgcggtctttgatttctacaccgatagaataaacggtaaccatgaagatgagcaacatgagtactcccggtatcagtgtattgcacaggtataccgaatagttcagccacggattgttcagtggatgtgtgtcaatcacgatcggttgcaggaagcccattgcctgatcttccgtagcccctttggcgtacagtacgctccttgccgcagagccggcagtgagttctcccatcattttcatgtctctgaatagtaaagaacctgcaatcagataggagtaattggtgtagaaagagattttgggctgccgttggctttgtgcctctgccgacaagcctttcgggatatagaagaaaccgtagatcttgccttcctgcacagcgatacgcgcatccgtcacattgctgtaatgagctacgacacctgtttgcgagaaagcatccagattgcggacaatgttgcgtgaagtagacgagtcgtccatgtctaccacgcccgccggaagattctgcggaagtcccgaatccatcagggtcgtgaaaaataggtagcagaacaatggagcgatgaccatgcaaaagagatagagcgggcgtgatactaaccgcctgcactccctctgcatgacttgccataaggctacatatttcttctttctctctttcatgattatttgttaatgataacggacatacccggacgaagattttccactttttccatcggagaagctttgacttcaaatgtcttcaggtcgaactgaccggtagttttggttgctttccaggcggcgtaagtacctaagtctttcagatagtatactttgagtctgactgttttattatccagcgcgggaacaacagcttcaaattctgctcccatagtcaggtttttgagcaagtcttcgcgtacgttgaaagtcacccacatatcattgagttcggctatgttcatgataggagcacctgtgcctaccagttcgcctactttcgggaaaatctcggaaacttctccggcagccggagcaatcagataggtttccttaatgtaagattctacttcggcaacagctcctttggcacggttcaccaacgcttcggcagccatcttgtcttcacgttccgcaccgttctttgccatagtatattgtgctttggcagctttctcagtagcgatggcagcgtcgcgttgtgcggttacttcgtccagcttttgtgcgggcatcactccttgttcatacaggttcttgactctcttgtatgatttctcggcaattgtaacaccggcctgagctttctgccacatttcataggctgcctgaatctgttcctcacgtgcacctttgattgctttttcgttttgtgcctgagcggcagcttcggcggcacgtgcctgctccattttagccactacatcgggggcttccagaatagccagtgtatctccggcatttacgctttgtccttctttcacacgaaattccagtatacgtcccggaactttgcttgaaacgcggtattcggtaacttcagcctgcccctgaataatttcaggacctttgcggagcatgaaaaagccaacgactgcaacgatggcaataactcccagtaaagtaagaaatgcaagcagcatattgctgttttgtgattttataggtgccatattattgatgaattttaaattacgaatgataaattgattgaatacctcagtcttataattgtcaattgtcaactgtcaattgtccattatttcagcgttcccaaagacttcttcagataaatctccgtcagcttcacgtcgatttgtgcgtcaatcttttccgattgggcggacagccatgccgtttgtgcttccaggacattgctggtggcaatgaccccttctttgaagcctaaggtggcataacggagattttcgtcagccttttccatattcttggttgccattaccagttttttgctggcttcctttactttaaaagcggattggttaacttgcaattcgatcttttctctcgcatcctgaagctgatattgtgcgattcgtgcttctgccttggcggctttggtcttgtaaatgccttccccccaatgccagataggtatctgtaccataacgcccacattccacattcctttgaatttattctcaaagctgttgaatacggaaggattggtcaccatataatttcccatcaacgcaatggacggaagatgttcggcgcgggtaacatttattttctgtttataaatctgagtagccagttcaagactgcgtatctccggacggttggcgtaagcggtggacatgtcgaagtgggtctctggtgtgagcagtggaatgtcctccatattttcgtctgccaacgtgataggagagctgagatcaatgccacatagttgacacaacaacattcgggccaggcttaatccgtcttccactttagtcagtgtcatttccgcttcgttgactttcacacgtacggacaaaccgtcggcttttgtggcaactccttcggcaatcatcttttccacatcgctgtccagctgctgcaaaagtttgagatagccttcggccagtttcttcttgttcactaaggatatgacttgccagtaagcctggtcagtgctcatgataacctcctgcatgcctccttgatgttgctgttgcgctaattcttcggcatactttgtgattttattatatgcacggattttgccgcccatgtataatggctgtgtcagcgtgatggcacctgcatatacatttcttgtatctgtgcggagcgcatccaccagtgagtttcctgcctggtcgagggcgggcaaggcagctcctaacttttcacttaaagaagcgataagcggtctcaactccgggtgtgcggtagcaatctctgtagccgtctgttgtatcggaccggccagattggtccccaatcccgaaagcgccgctttctggtcattgttcaataatgaaaattctttttgatttctcatgtaagttcccgtagccgagaaactgggcaggtagttggtaaatgcagctttgtgctgataatgagcggcatttattttttcattgcttatcaacagatctttgttgttggcaagagctaatgcgcggcaactatctaggcttaggaagctttgcgcttttactataaaagtcaggctcaacagaattgtcagaagaaatagttttttcatcgcatcttacatattaataaggtgatacttcttttttaaataaccccgttatcatataaattgtttattgaaatagttcatttttttgtacttgttgacttaaacaataattgcataaacaacgatgcaaatgtatgtgctttctgtgaaaacgcaaaatgaattagctttttttaaatgcttctctttggaaaatatgctatacttgcattttgaaacatgataaacatactataatgttattaaatctgacagaagaacaaatcactcaactcgctccggacgctgcgtctgtcaaagcaggaaaagggctggcgaaccggactaagtgggtacttctggagcatagtgaccgcgccatctggggacactgccaaggaagtggaaaaacgccttatcaaacagtagttgatacaaagaatattgcattcaaatgttcttgtcccagccgtaagtttccgtgtaaacatgggttggggcttttatttatgtatgcttcccatgctgatcttttcaaggaagcggaggaaccggactgggtaacggcatggctctccaaacgtgaagagaaggcggagaagaaagagcagaaagagaaatcggaaactccggtggatgaagcggcacaggccaagaggcaggccgtgcgtcatcagaaggtattggccggaattgatgatcttcagatctggatgaaagacttgctccgcaacgggctgctgaatatcccggaaagagcacatacactatttgaacccatatcccgcaggatgattgatgcacaggccggcggattggcgggcaggttacgatcgctacaggaaatcaattactatacagacagttggaaatatgagcttaccgacaaattgagtaaactgtatcttctgacagaaagttataagaatctggattctctttctgctgagtggcaaacggaaatccgtactcaggttggatatccgcaggcgaaggaagaagtgatgtccggcgtaccggtggcagaccaatggatcgttttgcataccagaagccggaagataaatgagctgcggacagaaactttctggttgtacgggaagtccagtcaccgtatggccctctatctaaactttctggctcccggagcgttgccggaatttaatctggttcccggtggtgtctatgaaggagagttgtatttttatcagggtgttggtgccttgcgtgccctgccccaaaacatgaaatggctggatagtaccttcctgccttcattgtgtgccgatataccggttgccatgcaatcttacagagcagttatacagactcatccgtttgcggaggaagttcctctcttggtggacaatgtcagactggtaacaagcggaaatacgcactatctgcaggatgccggaggtatggccattccggtgcatatcgaagagactgcacgtgttgacatactggctataacaggcggaaaacccttctcggcttttttgttggcagacgccgtttcctgtgaattgaaaacaatctggtatcaatctgaattttatttttggaaagatgaacttaactgatcatatcatcaatgtggcattgcttggcactgccacccgtgaactgataacgactgattttccggaagagttgcaagaaactctccgcgacattcaggcgaaagcagaggatgcggaagctctcttctatcagcagtccgctttgggctttgcctttgcacgtgccggagtggaagcgcaatccattgcaggagttacaaatgtgacagaagctccggaagaagacaaaccttacttcctccgtgaagtgggagagttgcttacttccctgtatctcaataaaaatcagtatcttttgctgtatgcttatcggagagctgccgacaaaggaaaattgatccctcctgcctatctgcaaactttattgcgaagagcttttgaccggaataatctctacaggtatgaggaacagcactggctgtctctgctggcagggcaaagaggacgttggcttcttccgcaaatgggatttcctgtatggggagaatccggcaacgaaacttgggaaactgcctctcacgaagaacggaaacgaatgttgactaacctgcggaaaaatagtccggagcaggggcttgccttattgcagaccgaactgaagaatgagtcggccgcccatcgggatgaactgattcagtgtttgcggtgggggttgagtaaatcagacgaagcattcctgcaagagatcgtggcgactgaccggagcagtaatgtcaaagaaacggcccggcgattattgtgtagtctgccggactccgaactggtgaaaatatacgaagaattattgcgggggaaattacatttcaatttccttttgggatggtcgtatgataagattgaatttacccctgaaatgaagaaattgggacttgaagaagtgagttccaataaaaacgagaaggatgatcgtttcttgttacgccagttggcggaacgtgttccattaagtttttggagtgagttttatgactgtgcgccggagaaggctgccggcaaactggcgaagaaccctccttttcagaaactgttcgacctgtcgaaaccgatcctgaatttcaacgactccggttgggcatatcataccttgaaggagaatgcagatgaaaaaatggcggacgcgttgatgggtttattgccttcctcccaacgggaggaaatagcttttcagtcggagagaggcggctatattccggatagctggttcaacgaagacggcatcggatggggaatgaaattctccactcgtgtattccagcggatgcttcggaataattactatctccctaaggagacagccgaacaactggcattatacttcccgtccgagatgagaaaacccatcgaacagatagcgcttgcaacggccgcacaggagaataatacctccactcgtttttgccggttgatgatggaatacatggatttgaagcagagaatagataccttattaaataatgactaataaaaacagaaagaagatatgagcactttattaagacaacatgctgaacagcaatttgcagaagaacttcacgagttgaaacagaatgaaacaaatcccgttccggagaattgggagatgtctccgcagtcagtggttacctacctgatgggcggtaaattgaaaaacgggtttgaagtttctcctaaatatataggtaaccgtcgtctgatggaaatagctgtggcaacccttgtcaccgaccgtgcgctgctgctttacggactgcccggaactgcgaaaagctgggtgagcgagcatattgccgctgctatttccggtgattccactttgatagtacagggtacggccggcaccggtgaagaagcgatccgttacggatggaactatgcccgtttgctggcggaaggtccgagtgtgggagcattggtgcaaactccggttatgaaagctatgcaggaaggtaagataggccgtattgaggagctgacacgcatcggttccgatgtgcaggatacgctgatcaccattctttctgaaaagacattgcccattccggagctgaatacagaagtacaggcaatccgcggtttcaatatcatcgctactgctaataatcgggataagggagtcaatgatctgtcaagcgccttgaaacgccgtttcaatacggtcattcttcccttgccggattctattgatgaagaaatagatattgtgcgccgacgggtagagagctttgagaaagtaatgcagctcccggctgaaaagcctgctctggaggagattcgccgtgtcgttactatcttccgtgaacttcgtcagggtgctactgccgacggtaagacgaaactgaagactccgagcggaacgcttagcacggcagaggctatttcggtggtaaacaacggactggcgatggcaggttatttcggtgacggagaaattcatgccgaagatctcgtatccggtattttgggtgcagtggtcaaagaccccgtacaggataaagtcgtttggcaggaatatatggaaacggttgtgaagaatcgggacggctggaaagatatttaccgtgcttcaagggatatgatttaaaaagaaaggaagaaatggctattcatttactaggcatcaggcatcacggtcccggctcgtgccgcaatgtgttgaactacttgcaggaactgcaaccggatctgattctggtagaaggtccggcagaagccgaagcgctgctgccctgtgtggaaaatccgcagatgacgcctccggtagctttgctggcataccagccggacgagcctcagaatgcggtgttctacccttttgcggagttctcgcccgagtggcagacgatgcgttatgccgtacagaaccggatacctttccgctttttcgacttgcctctgatctattcgctggctcttcggacacaaaagacctctgaacaggagacggaaacgaccgctgaagtcgcagaagccggcgacccgttcgactggctggctcatgccgcaggatttaccgatggtgaatcctggtgggaaactatgattgaacaccggcaagaacctgccgatatctttcaggcggtacaagaggctgtgactgctcttcgggaagaacttccggggcacacctctccgcgtgacctgatacgtgaagcgtggatgcgtaaaatgatacgtgcggcacagaaggagaatttcgaacgcattgtcgtcgtctgtggtgcatggcatgtacccgctctggacgatatgcccaaagtaaaggacgataatgaactactgaagggacttcccaaagtcaaggtagaatgtacatggattccgtggacgtatgaccggcttgctttccgcagcgggtacggtgcgggaatcgaatctccgggctggtatcattatctctggcatcatccggaggatgatggcacgctttgggtgagccggatcgcctctctgttgcggcagaagaatatggatatctcggtagcccatgttattgaaaccgtccgtctggcacaggtgacggctgctttgagagatctgccttatccttctctgaatgaatataacgaagccgtcactacggtgatgggtttcggagatgatatattgttgcagattatcaaagaagaactgatcatcagcaaccgcttgggaagtgtacctgatgacgttcccaaagtgcctctgctggtagacgtggagaaaatacaaaaacgtctgcgtgttccgttcaccgccgagatcaaagaactgatattagacctccgcaagccgaacgatctggagcgaagtatcttcttccatcgcctgcaactgctgggcattgactggactatcctcggacggatagacgggaaaggtactttcaaggaaaaatggaccttgtatcacaaaccggaacagatcatccaaatcattgaacgggctatctggggaaacacggtgatggaagctacgcagaaatatctgttgaaacagatggcggagattcagcatatcccggaactgacagctttgttgagtacggtcctccctgccgatcttccggcgctggtggaagcgatgaccgtacagttggaccgtctttcggctgcttccaccgatattctggaaatgatggaagcggtccccgatctggtgaatattgtccgttacggaaacgtgcgtaaccttgatttctcgaaggtcggtgatatgctcgaagccatgattgcccgtattcttgcgggtggtgtattggtgtgtatcaatatcgatgaagaggctgcgggtgatcttttgaataaattggttgccacggactatgcgctctccattctgaatcgggaagaactgaacctgatgtggcgcaatttcatcggtcaggtacgttcttctgccaatgtgcatccgttgttgtccggttatgctacccgtctgctgaatgacaaaggggaaatctccgcagaggagatggagacgacactcagtttttattcttccgttggcaatgctccggcagatatggcatactggttcgaaggctttttgcgttcatccggttcgatcctgttgctggacgaccgtctctggaatttggtgaataactgggtatgttcgcaggacaaagaaacatttatggaactgttgcctgtattgaggcgtactttcagcgaatttacctctgccgaacgtcgtaagctgggtgagaaagcccgtcgtacggattctacgggcacatcatctgccgtaggagcttcggtaacggagaatgagtgcctgaatcgggaagaagcaaagaaggtaatccccgtgattcgtcaattattgggactggaaacaaagtaaaggaaagaagatggaagaagaattactgaaaaggtggcgtctgatactgggcggcgatgaggctgacggtacaggcgtgacattgaatctggaagaacagcggatagaccattctctggaagctgtatatgatagtgacagaagaggggggctgggttcctcggctcccaaagtaagccgatggcttggagatatccgtgagttctttccgcagacagtggtacaagtgattcagcgggatgccataaaacgtctgaatctgaccagtctgcttaccgaaaaagaaatgctggaaacggtcgtccccgatgttcatctggttgccaccctgatgtcgttaagccgggtgattcccgaaaagaataaggagatggcacgccaggtagtccgcaaggtggttgaggagttgcttcgcaaactgtcggctcctacgcaacaggcggtaaccggtgctttgaaccgttccagccgccgcaggaacccgcgttacaatgagatagactggaaaacgaccattaccaagaacctgaaaaactaccaaccggactataagacgattattcccgaaatccgtattggctacgggcgtaaacggaaagcgatgaaagacattatcctgtgtctggatcaaagcggttctatggggacgtcggtcatttattccggcatattcggttctgtattggcatccattccggcggtatctacccgtatggtggtttttgatacggcagtcgttgatctgacggatgatttgcaagatcccgtggatctgcttttcggggtacagctcgggggaggaaccgatatagcccgtgcgctgacttattgtcagggagtcattacccgtccgcaggacacggtgatggtgttggtgactgacctttacgaaggaggagactccagagaaatgagaaagaaatttgtctcgttggtcaatagcggtgtgcagttgattgtccttccggcgttgaacgatgacggtgctccgtcctatgacaaggggcatgctgagtttctcgcttccataggagtgccgacatttgcctgtactccggataagtttccggaccttatggcggctgctttgagtaaacaggacattggaatgtgggtttctcagaatgtaaagagtgaatgacagctattggatagaaaagaaagaaggctgtccctcattgcgaaggacagcctttcttagcttatataaatgtaaggggattgctaattatagagcacctacttctttcaaagcagcgtttgttccgtgaacagcttttgcgctggcagcgaacttagctttttcgtcagcgttcagatccagttcaacgatcttttcgataccgttcttgccaaggattacaggaacaccgatgcaaatgtctgattcaccgtattctccttccagatatactgaacaagggatcatcttcttttggtcgtgaaggatagattcaactacgaatgctcctgctgcacccggtgcataccatgcagaagtacccagcaacttagtcagagtagccccacctaccatagtagcagcagccacttcgttcagtttttcttcagagatgaagttagttacaggcatacctttgtaagtagcgaagcgagtcaaaggaatcatagtagtatcaccgtgaccaccgataaccataccttctacttcgttggcgttgcagcccaaagcctgagacaagaaatatttgaaacgagagctgtccagtgcgccacccataccgatgatgcggttcttcggcaagcccagagctttcaatgacaggtaagtcattgtatccatcgggttagagataacaacaaggattgcattgggagaatatttcaagatgttttctgccactgatttaacgataccagcgtttacaccgatcagttcttcgcgagtcatacccggtttacgaggaatacctgaagtaattacaacaacgtcagagttagcagtctgagcatagtcgttagtgcagcctactacagttgtgtcgaaacccaacagttgagctgtctgcatcatatccattgctttaccttctgaaacgccttctttaacgtccagcattactacttcgtctgctacttcattgaaagcaagtacatttgcacatgtagcacctacgttacctgcgcctactacggttacttttgacataatactatatatttaaaaagttgataatttatttcatgctttttagcgcgacaaaattacaacgataatcctaattaaagaaatttttccgtaataattttcgttaaagaaaatgcccaagactatgttactctgttacgaaatgattacttttgtgcccgttatcgattaacaattggaactatgaacaaaaaaagccttcttattgcagctgtagctgttttggtgatagcgattatcggcatcacttatttgttgtttactgaaaagaaagccaatcgcgagctggtacaggaatttcagttggataaggaagatttggagaatgagtatagccagtttgtgcaaaagtatgatgagttaaagtttacggtaactaatgactctctcgcactgttgctggagcaggaacaattgaaaactcaacgattgctcgaagaactccgtaccgtgaaaagctcgaatgcaacggaaatccgtcgtttgaaaaaggagcttgccactttgcgtaagatattggtaggctacgtcaatcagatagactcactggacagaatcaataagcgccagcaacaggtgattgcagacgttactcagaaatacaacactgcttcacagcaaatcagtacactttccaaagaaaaggagaatctggataagaaggtgacactggctgcccagctcgatgtgaccaatatccgtatcgaaccgcgcaataaacgggggaaggttgcaaagaaagtgaaagacatcgtgaagctggctatcagctttacagtcgtgaagaatattacggcagagaatggcgaacgtaccatctatatacgtatcaccaaaccggataatgacgcactgaccaagagtgcatccaacactttctcttacgaaaaccgtacactgacttactccatcaaaaagtatatcgaatacaacggtgaggaacaaaacgtgaatgtattctgggatgtagaagagtttttgtatgccggaaactatcgtttggatatcttcgagggcggtaatctgatcggctctcagaagtttacgctggactaaccgatataaattcaagaaaaaaatgcgccaacaagcagtaaaaggctttttggcgcatttttctattagaaaaaggttaactttgtgaaaactaatagaataatgcgtatgaaaaagcacttgactcagctactactatcattactgtttctggtggtgacagccatgacttgcgatgaacaggattgggctgaaccgatagatgttccctgtactttgaaagaagtggagttatatcattgggataatgcaggtgagaaacctaaggaggctgttgataacaaagttctcaaagaagcttatatgatggagattcgtctgctgacagatgcgggggaaaaagatccggaatcttatgacgccgatcattatcttcgccatgtattatcggatggcatcaaaaagattcagatatttacggaaacagcttttaatgaagaatttcccgcaggagcagaagtcacttcctgcttttatgactatccgaagacgtttgttaaagatcagcagacagattatactgttaatggaggggttatatccatgatagatgaagtaaataagatatataaggcgttattgaccattccccaatcaggcggagagttccgttttcgtgtagtgctgacgatggaaagcggtgaaacggttgaacggctgagcgatccggttactttctattaaatctgctgtctatgaagaaaatacatttattagccatgctattgtttactgcatgtgttgtgcctgtatcgcaggcacaggaaagtctgtttcttaaagatccatctaccaagaataagttgctgcagttagacttggatgtgggaaccaactttgacctggcttatcgggggaagggaaatatgttcactgcaatgtcggatcagaaatctgtatttcctgctatcagccttcgtttgcaacatttcttttcgcgtaaatggggatggtatacgaatatccgtttggggattcccgtgaaatataggcgagattgttatactgaattagcccatgcagtcgaagcggattactatgtgaataatctcataccgggaacgcaaaagccggacgttaatccctgtctggattttggtgttgcttatcgctttgaaaattcccattgggctttttatcctcgtttggggattggtgtgaatagcatttcctatcagcgtgtttgtgcggaactaaagaaaaaaggaggaaatgaattatatagaatagagtatagaggggatgatgaaagtaattatggcagtgagagtattgatgcttttattctttcggcaggtattaccgccaactataagctcagtcgaaattgttttttactgttgaatgtcaattatatacagccattggggagatttacttatcgtaaatatgtaacagacctttatacgggagaaaaggtggagagaggagtctataaaagttctacattcgcccgtgatctgaatgtaagtgtcggattcggattccctttttatctgggaagaaagactaatagaaaatcaccgcatagagaaagaaccaggcaattgatggaacagaaacggaaaacatacgggttgtttccgggaaataagtagccatttaatcatttctttgcagtgatgagcgaatcgaatttagcctttatacaatgtttgaaaaagaaaaaactctgccatccgcaacaattggattaacattcttatgatatacttacgtgtcagctagtctctctataaaaataaaaaactataaattgctgtcatctgtcactttgttgggggtaatatcttgaatatgagtgattaatgaagtgacggcagtaggtgacggcagtgtgacggcaaattttgctgtcacactgccttgttttcaatggttccttatggtctgtttgtagttctatatagagctttttagtttctcccgtttgaaacttttgtttcttcagcttggaactaaagtttcatcggcttgaaactaaagtttcaaagccttgaaaccaaagtttcggacgcttgaaaacattggttccagcgtatggaaactagttatactagagtgtatgatgtcaaaagtcaatagtagcgagttcagtgtagtcgatgtgcgtgtgacggcaatagttgtcatcaccgtgccgtcacctgttgccgtcacagcgttaagccttgactatgagtgtgttatttgtgtttttgtgatgggtgacagcaataattggataaacaatacatagagagagaagccggttgatacatctattatgataggatttatcagattgataatcgtttaagagctttttaggtgccttaacgacaaaacaagtggctgattgtgttatattccctaagtaaccaaataaaaataacaagattatgaaacagaaaagagctaaaattggatttaccggatgtgccaaagcgtatatccggagtttgcaggaagaagggcgctattctacggcacatgtgtataagaatgcggttctttcatttacgagatttcatggcagtacgtatattgcattcgagcagatcactcgcgagtctttgcgacgttacggacaatacctgtacgattgcaaactgaaactcaatacgatctctacctatatgcgaatgctgcgctgtatttacaatcgtggtgtggaagctggtatcgcccgttttatcccccgattgtttcgtgatgtatataccggtgtggatgtccggcagaaaaaggcaatgcccgtaaaggaactgcatacacttctttataaaacaccccagtctaagcacttgcggcgtactcaggagattgcccgactgatgttccagttctgcggaatgccttttgcggattttgcgcatttggaaaagtcggcattggcacaaggggtattgagatataaccgtatcaagacaggcacttctgttagtcttgaggtgctggagtcatctctgccaacgatcagtaaacttcgcaataatgaccctgttcgggaagatggaacgaattatttattcagtattctgagagggaataaaagcccaaaaggtgaaagcatgtataaagaataccagtcggcgcttcgtcggttcaataatcagctgaaaagtctttcaagggaacttcacttaaagtcggctgtcacctcatataccatccgtcattcttgggcaacgaatgccaaataccagggtatacctattgaaatgatcagtgaatcattgggacacaaatctattaagacgactcaaatctacctgaaaggttttgaactggaaaagagaacagaagcaaatcggttgaattgtttttacgttgaaaactgcaataattagaatagaatataatcagagtgctgactattagtgtgttatcatgtctattacttcttaggtaacggaaataaatacgacgcaaagatatataaaaagaatctcatatcccaaacttattatacattattttatttctctgacttaagaaaataaaataacactatgagaacacgaataccactgacttcatgttccgaacccttattgtttgtcatccgacaaaatctccttcataacccttttatacagtgcttctcgcaaaggccgctgcctttttcgcttcttttcccctatgtgtaaagtccggtaatggacttccgttacctaagaagtaatagataaatgtaagtagtaaattgtgacacgcaattcaaacaacaagctcattttgcatgccttctatttactttggttctgaatttatccattgggatatatgcttgtaaaggtacacacacagtgacaaaataaagagaatgaacattgcttcgatgtgggcaatgtcttaaaaagggtttttagtttacttatttaaaagtaaaagaagaaatggaaagtttatggaaagtctggttctccagaaggagaaaggtgtatgttcggatagcccgtcaatatggttccactccgtggcgggtgtattatttaggacatggaggcaggtgcaggtcgctcaaagacatgcagatattggaagcgttacagcggcagggagttatttcgcatatttacccttggtgataattgcctgaaaaatacttgaacatatttaattatgtgtccgacagaaatatgaataattataaaatatggggtgagatgtttttctaaaaaggttactgtgaagtacccgaacggggataaaccctttatagcatgtgtatgtttcccacaacatgcttattgcttatataaacggagtctcttggatgtccgttttatataattgtttgtttttgtttaagtacattctgtcctggtgaggaaggatgtacttttttatgcccgaaagtccggaatcagatagttacgaaggtccggtcggaagatcagcgccttccgtccgctccccacatcatcttgctgcggagggtatcgaagaaaatatgattgaaccgtttcactacttttatactgtagtctgcccggcgaatggtcagctgagttgtctccttgcacgtttcgctgctgccgtcgatggcaacgaggaagttatggctgcggctttccacgtccagcgtgatttcccagtcgtcacgaatgacgataggacggacgttgaggctgtgcggagctaccggggtaatggcgatcgtattggaatgaggaacgatgatcgggccgcctacgcttaatgaatacgcagtagagccggtaggagtggcaatcaccagtccgtctgcctgataagtattcagataagcaccgttgatcgcagtgcggatgctgatcatggaagaactgtcccgcttgagcaccgcaatttcgttgagggcataaggcgattcctggagatttctgtcattgcagataagctgcaatacacttcgttcctccacactgtatctgcctgcctgaatctcttcgaaagtcacctccatctcttcgggtgaaacatcggcaagaaatcccagtcgccctgtgttgatgccgagaatggggatttgttttctacccacccggcgggcagctttcagaaatgtgccgtcacctccgatgctgataaccatatcggctgtgaagtcgttgccttcgagcagggcatcgacaggcacttccatttttaaatctgccgtcaggaactggtaaaactcccggcacatacagatttccgctccctgcttcttgagaagctcgaacagtctgagtgcatgcaaagactttttaggctgatacgtatttccgaaaatggcaaatttcataagctgtttcattagtttcggttgcaaaattggcattttttcttggatttctactttaaataaccaaaaaagaactgagaatgcgtttcgtattattaggcaactaataataatatttgtatttttgcggcaaatattgcgtaaaactatgactaaattaagtgtaaacataaacaaggttgctacattgagaaatgcacgcggaggggatacccccaatgtggtgaaggtagcacttgattgtgaagctttcggggctgacggtattactgttcatccccgtcccgacgaacgccacatccgccgggcagatgtatatgatctgcgtccgttgttgcggaccgaattcaatatcgagggctacccgtcgccggagtttatagacctggtattgaaagtgaaacctcatcaggtgacgctggttcctgacgatccttcgcagattacttccaactccggttgggatacaaaagcaaatctggaatttctgtcggaagttctcgatcagttcaacagcgcaggcatccgtacttccgtctttgttgccgccgatccggagatggtggaatatgcggcaaaagcaggtgccgaccgtgtggaactttatacggaaccctatgctacggcatatccgaagaatccggaagcggctgttgccccatttgtggaagcagccaaaacagcccgcaagctgggcatcggcttgaacgccggacacgacttgagtcttgtgaatttaaactatttctataaaaacattccttgggtggacgaagtatccataggtcatgccttgatcagcgacgcattgtatctgggactggaacgtactattcaggaatataaaaactgtctacgctaatgaatgtattgatgttattggcccagggtgccatgaatatggccgactcgctggcaactgccaacccggtgctgactccggtcagcgctcccgagatgaatatgcttgatatggctatcaagggtggttggattatgattgtactgggtgtactgtctgtagtctgtttctacatcttatttgaacgtaactatatgatccgtaaagcgggaaaagaagacccgatgttcatggaacggatcaaggattatatccatagcggtgaaatcaaagcggctatccagtattgccgcacgatgaacactccttcggcacgcatgattgaaaaaggaatcagccgtctgggacgtcccatcaacgatgtgcaggtagccatcgagaatgtcggtaatctggaagttgccaaactggaaaaaggcctgaccgtcatggcaacaatctccggtggtgctccgatgctcggattcctcggtacggtgaccggtatggtacgcgcattctacgaaatggcgaatgcgggaagcggaaacatcgatataaccttgctttccggcggtatctacgaagccatgatcaccaccgtaggcggtctgatcgtgggtatcattgccatgtttgcttacaactacctggtgatgctggtagaccgtgtagtaaacaagatggaagctcgtacgatggaatttatggatctcttgaacgagcctgcccaaaagtaaccctgagacgttaatcactatcattaaccactaatcaataataaagtgggattaaaaagaagaaatagagtatcgcccaatttcagtatggcatccatgacggacgtcatcttcctgctgttgatattctttatgattacctctacggtggtgtcgcccaatgccataaaggtgttgttgccgcaaggcaaacaacagacttcggccaaaccgctgacaagagtcgtgatcgataaagacctgaacttctacgctgctttcggcaatgagaaggaaaagccgctgtcgttggacgaactgactccgttcctgcaaggttgcgcggagaaagaaccggagatgtatgtggcattgtatgcagatgagtcggtgccttaccgtgaaatcgtgcgggtgctgaacattgcgaatgagaatcattttaaaatggtgctggctacacgcccgccggaaaacaaataaagtaagtagttgctacttaactactaaaaaaaagaaacaattatggacgacagaagaaaaaagggtgaattcgtcggcgcgctgggtgcactgttggtacacgtggcagtgatagctcttttgattctggtgagctttacggttccccagccggatgaagacgcaggcggcgtacctgtgatgctgggaaatgtggagtctgcccgaggctttgacgacccttcgctggtggacgtggatatactgcccgaagaaccggaagcacctgcacctgcggaaacgcagccggaactgccctcggaacaggatctgctgacacagaccgaagaagagacggtagtgctgaaaccgaaaacggaacctaaaaaggagaccgtgaaacccaaagaggtagtgaagcccaaagaaccggtgaagaaacccgaaaagacagaggcagagaaagctgccgaagcgaaacgtcttgccgaagaaaaagcggaacgtgaacggaaagccgccgaagaggctgcgaagaaaaaggttgccaacgctttcggaaagggagcgcagatgggaggcagcaaaggtacttccgccagcggcacgggaacagaaggcagcaaggacggcaattcatccaccggagcgaagaccggaaccggaggttacggaacatttgaccttggcggacgttctttaggtacgggcagtctgccaaagcctgcctataatgtgcccgaagaaggacgtgtggtagtcaatatcaccgtcaatccggcgggagtagtcattggaaccagtatcaatcctcaaacgaataccgtgaactccaccctgcggaaggcagcggaagacgcggcaaagaaggctcgcttcaacaccgtggaaggaccgaacaaccagactggaaccatcacttattattttaacctgagatagtatcactaatcaaaaatataggattatgggaactgtatatgctttttttgcagatggctttgaagaaatagaagcctttactgctgtcgacactttgagacgtgccggactgaatgtgcaaatcgtatctgtcactccggatgaaattgtaatgggcgctcacgatgtgtcattgctctgtgatataaactttgaaaactgcgatttttttgatgccgatctgctgttgttgcccggaggaatgccgggagcagctacgctcgataaacatgaagggctacgaaaactgcttcttgactttgctgccaaaggaaaaccgatcgcagcgatctgtgcggctccgatggtattgggcaaattaggtttgctgaaaggtcggaaagcaacttgctaccccagctttgaacaatatctggaaggtgcggaatgtgtcagtgaacccgtagttcgggacggaaatatcatcacaggtatgggaccgggcgctgctatggagtttgctctgaccatcgtagatctgttggtcggcaaagaaaaagtagacgaactggtagaagcgatgtgtgtaaaacgctaagctgtctatgaaacaatctgtgattattgtcgccggtggaaagggcttgcgaatgggaagcgatcttcccaaacaatttcttcctgtcggtggcaaacctgtgctgatgcgtacgctggaagcattccgcaagtacgatgcgatgcttcagattattctggtacttccccgtgaacagcaggacttctggaaacagctttgcgaagaacatcatttttcggtggaacatcttgtggcagatggcggcgagacccgttttcattcggtgaagaacgggctggcgcttgtggaggctcccggtctggtaggagtgcacgacggagttcgcccgtttgtatcccttgaagtgattcgccggtgttacaagctggcggaacagcataaagctgtgattccggtggtggatgtagtcgaaacgctgcgccatttgacggatgccggaagcgaaacggtgagccgtactgaatataagttagtgcagactcctcaggtttttgacgtggagttgctgaaacaggcttatgaacaggagtttactccgttttttacggacgatgcttcggtggtcgaagcaatgggcgtacccgtacatctggcagaaggtaatcgtgaaaacataaaaataacaactccctttgacctgaagatcgggagtgctctcttgtaaatgttcgatttaaccacacgcgacatcaaatttatctccggtgtagggcctcagaaggccgcagtattgaacaaggagttggaaatctactcgttgtacgatctgatttattattttccttataaatatgttgaccggagccgcatctattacattcacgaaatagatggcaatatgccgtatatccagctgaaaggagagattctcggcttcgagacgataggcgaagggcggcaacggcggctgacggcccatttctccgatggaacgggaatcgtcgacctggtgtggtttcaaggcatcaaatatatattaggtaagtataaacttcacgaagaatacatcatcttcggtaagcctaccgtgtttaacgggcgtatcaatgtggcacatcccgacatcgataagccggatgatctgaaactttcttccgtcggactgcaaccttattataatacgacggagaaaatgaaacggagttttctcaattcgcatgcgattgagaagatgatggctacggtgatccagcagatacaggaacccctgccggaaacgctttctcccaaaatcctgtcggaccatcatctgatgcctctgacggaggcactccggaatatccatttcccgacgaatcccgattcgctgcgcagggctcagtatcgtcttaaattcgaagaactgttctacgtgcagctgaatatcctccgctatgcgaaagaccgccaaagacgatatcgtggatatatctttgaacgggtaggggatgttttcaatactttctattcgcagaaccttccttttctgttgacgggtgcacagaaacgggtactgaaagaaataaggaatgatgtgggaagcgggcggcagatgaaccgtctgcttcaaggggacgtgggtagcggtaaaaccctggtagcgttgatgagcatgctgcttgcactggacaacggttttcaagcgtgcatgatggctcccaccgaaattttggcgaaccagcattacgagacaatcaaggagctgcttttcggtatggatatccgtgtcgaactgctgaccggatctatcaaaggaaagaagagggaagcgatcctgaccggactgctgacgggagacgtgaagatcctgataggtacgcacgcggtcattgaagacacggtgaacttctcttctttgggactggtcgttattgacgaacaacaccgcttcggagtggcgcagcgtgcccgcctctggacgaaaaatatacagccgccccatgtgctggtgatgaccgccacgcctattccgcgtacactggcgatgacgttgtatggcgatctggatgtttctgtcattgacgagctgccgccgggacggaaaccgataaccaccattcatcagtttgacaaccgtcgggaaagtatgtaccgcgccgtacgcaagcagatagaagaaggacggcaggtgtacatcgtctatcctttaataaaggaaagcgagaagatcgacctcaagaacctggaagaaggttaccagcatatcctggaagagtttcccggctgtaccgttgccaaagttcacggcaagatgaagtctgcggagaaagatgaacagatgcagctctttatttccggacaagctcagattatggttgccactaccgtcatcgaagtcggggtgaatgtgcccaatgcttctgtgatgatcattgagaatgccgaacgtttcggactttcgcaactccatcagttgcgcggtcgggtgggacgtggcgccgaacagtcttattgtatccttgtgacgaactacaaactgaccgaagacacgcggaaacggctggaaataatggtgcgcaccaatgacggctttgaaatagcggaagcagacttgaaactgcgcggccccggtgatttggaggggacgcagcaaagcggcattgccttcgatctgaagattgcgaaccttgcccgtgacggtcagctgttgcagtacgtccgttcgatagccgaagatattgtagataacgacccgtcggcccaaagtccggagaacgagattctgtggcggcaactgaaatctctccggaaaacgaatgttaactgggcggctataagttgaaaaacggttaaacatgcagtttatttgcgggaatgtgttgcaaaacatgtttcgtttctattcctcctatttatagggctttaacgccgttttttctgttcttttcatctccgtacttctgaaaaatagttaatgacttacttgccctttcatcggaaaatactatctttgagggaattttttatagtaaatgtatagtttaatcttttgaaagtcacacatcatgatcgaaaaaacgctggttattttgaagccgtgtacccttcaacggggattggttggtgagattactcatctctttgaacgtaaaggactacggttggccggcatgaaaatgatgcaactgacggatgaattattaagcgagcattatgcccacctgagcagcaagcctttctttcagcgcgtgaaagattcgatgatggcaactcctgtcattgtttgttgttacgaaggtgtggatgctattcaagcagtccgtacgttggcgggaccaactaatggacgtctggctgcgccgggaaccattcgtggggattatagtatgagttttcaagaaaacatcgttcatacttccgattctccggaaactgcggctatcgaattaacgagattttttaaacctgaagagatattcgactacaaacaggcgacttttgactacctgtatgcgaacgacgaatattaattgaattgacaagaacgaatgaatttcaattgcattattaaaacaggattggtagctgtagcagctatggtcagcctgagctctttctctcaagacctgattgcccgccaagctccgatagacaagaaattaaaaaccgtagactctttggcactgcagaaacagatccgtgccgaacagtcggaatatcccgccttaagtctttatccaaactggaacaaccagtatgcacatgcttacggcaatgctatcatccccgacacttataccatcgacctcacaggcttctgtatgccgactccgagtacgaagattacttcgcctttcggtccccgctggagaagaatgcacaatggtctggacctgaaggtgaacatcggtgacacgattgtagctgcctttgacggtaaagtacgtatcgtgaagtatgaacgcagaggatatggtaaatatgtagtgattcgtcatgacaatggattggaaaccatatacggacacttgtccaaacaactcgttgaagaaaatcaattggtaaaagccggtgaagtgatcggtctgggtggtaacaccggacgttctaccggttctcatctccactttgaaacccgcttcctgggaatcgccatcaacccgatttatatgttcgacttcccgaaacaggatatcgtagccgatacttatactttccgcaagacgaaaggtgtgcgtagtgccggttctcacgacactcaggtagccgacggaacgatccgttatcataaagtgaagagcggagatacattgtcacgtatcgctaaagtgcgtggagtatcggtcagcacgctttgtaagctgaaccgtatcaagccgacgaccaccttgcgtatcggacaagttttacgttgttcgtaaagatgtaatacaataatagctttggaagagggcactttaatataatttagagtgccctctttctgtttttacttaattattgttacctttgcgcactatttggaagaagatgaaagataccaagcaacaatttgaacatgtcatcgccttgtgccgtgacttattctccaagaagctgcacgattacgggcctgcatggcgtatcctgcgtccggcttcggttactgaccagatttttatcaaagctaacaggattcgtagtatcgaaaccaaaggggtgactctggttgacgaaggaatccgttcggaatttattgcgatagtcaattatggcattatcggtctgatccagctggaactgggctatgccgaatctgccgacatcagcaatgaggaggctttggctttatatgacaagcatgcaaaggaagcgctggagctgatgcttgccaaaaatcatgactatgatgaggcttggcgcagtatgcgtgtgagttcctacacagacttgattctgatgaagatataccgtaccaagcagattgaaagtctggcagggaacacgttggtgtcggaaggtatcgatgctaactatatggatatgattaattattcagtattcggattgatcaagatagaatttgaaggataagaacttacatatcatccagaagacaggagcgaatgtctgccgtttccttttagcggcatcgttcatcttttccggttttgtgaaggctgtcgacccgctgggcttccagtataagatacaggactatctgaccgccttcggggtgatttcatggtttccttctttcttcccgttgttgggaggcattatattatccgccatcgaattttcaatcggtatcttcctgttcttcggtatcaagaaaacaatctctaccacattggcgttggtgctgatgattttcatgacaccgctgacgctgtatctggcgattttcgatccggtgtcggactgcggctgttttggcgatgcctgggtgttgactaactgggagacatttgcaaagaacatcgtactgctgcttgccgcgattgctacattccagtggaggaaaatgctgatcagattcgttacccgaaagatggaatggctgatttctctgtacacgatattctttgtatttacactgtcgttttactgtctggaccgtctgcctgtgctggacttccgtccttacaagatcggacagaatatcatgaaaggcatgagtattcccgaaggagcgaaaccgagtgtatatgagagtgtctttatcctggaaaagaacggggaaaagaaagagtttacactggacaattatccggacagcacatggacctttgtcgatacgcataccattctgaaagaaaaaggatacgagccttcgatccacgacttctccatgatggatatgagcacgggtgatgatatcacggaagacgtgctgacggatatgggatataccttcctgctggtggcacatcgtatcgaagaggcggacgacagtaacattgatttgattaatgagatatatgactactcggtagagcatggttacagattctactgcctcacttcctcaccggaagagcagatagaattgtggaaggacaagaccggtgcggaatatcctttctgccagatggatgacattacgctgaagacgatgattcgctccaatccgggactgatgctgataaaaaacggtacgattctgaacaaatggagtgatgaagacattccggatgaatatgtactgactgacaaactggagaatctggaactcggtcagcagaaggtccggagtgacgtacatacgattggatatgttttcttgtggtttgtcattccgctgttgctggtgttgggagtggacattctgattgtccgccgacgcgaacggaagaacgaaaagcggaagcagcaacaggaagtaaaagaataataaatttattaaccctttaaataaagaacaaaatgagaaagaacattgttgcaggaaactggaaaatgaacaaaacccttcaagagggtatcgctttggcaaaagaactgaacgaagcattggctaacgaaaagcctaactgtgatgtaatcatctgtactccgtttattcacctggcatctgtaactccgttggtagacgctgctaagatcggtgtaggtgctgaaaactgtgcagacaaggcatccggtgcatatacaggtgaagtttctgctgaaatggtagcttctacaggtgcaaaatatgtaatcctgggtcactcagaacgtcgtgcttactacggtgaaactgttgctatcctcgaagaaaaagtaaaattggctctggctaacggtctgactccgatcttctgtatcggtgaagtgctggaagaacgcgaagctaacaagcagaacgaagtagtagctgctcagatggaatctgtattctctctgtctgctgaagacttctctaagatcatccttgcttacgaaccggtttgggctatcggtacaggtaaaacagcttctcccgagcaagctcaggaaatccacgctttcatccgttcaatcgtagctgacaagtatggcaaggaaatcgctgacaacacttctatcctttacggtggtagctgcaagccttctaacgctaaagaactgttctctaaccccgacgtagacggtggactgattggtggtgctgctctgaaagtttctgacttcaagggtatcatcgatgcgttcaatgcataattagaatatctttcgggaactgactaaaaagtagatagtaactctaaactctcctccttccagaaggaggggaattgcagatagtatcgactttttagccacttcctgaaattaaacttttatcgaatgagaaaactaggtttacttttatggatgctggcttttaccgctgttggtgcacaggcgcagaacatcatcaagagtctggaacgtacagtgccgggacagggaaaggtgacgattcatcaagaccctaagatagaggcattgataggcgtggaacgtccttctatgggcgaacagaaagtgttgaaggcagccggattcagaatacaggcgtatgccggtaataatacccgtgaggcaaagaatgatgcttatcgtgtagcttcccgcatcaaagagtatttccccgaactgacgatttacacttcgttcaatcctccccgctggctttgtcgtgtgggtgatttccggagcattgaagaggcggacgcgatgatgcgtaaactcaaggcaaccggtgtattcaaagaggtctctatcgtcaaagaccagatcaatattcctttataattgtatcatgttagaaaaagaagaaattgtctctccgaatctggaggagttgaaaagtcattatcacagtattattactttgttgggtgaagatgccggaagggaaggtttgctgaagacccccgaacgtgttgcgaaggctatgctgagtctgacaaaaggttatcacatggaccctcatgaagtgttgcgttcggctaagtttcaggaagaatacagtcagatggtgatagtgaaagacattgatttcttctctctctgcgaacaccatatgttgccgttctacggaaaagcacatgtggcatatatccctaacggctatatcacgggattgagcaagattgcccgggtagtcgatatcttttcccatcgcctgcaagtgcaggaacgcatgacgctgcaaatcaaagattgtatccaggagacactgaacccattgggagtgatggtggtagtggaggcaaagcatatgtgtatgcagatgcgcggcgtagaaaaacaaaattctattactactacttcagactttacaggagctttcaatcaagccaagactcgcgaagagtttatgaatctgattcagcacggcagggtgtaatacgctttacaaaatgtggacgatgtagttccccgtcaatgaggattgcctccggtaccgatgaaggggtgtctcggcaccgatgagaaatttagcgtaatacaacgcggtcgcccaggcgcttcgccatcagactttgcacttcccgcatctcattgtaacgctgcatcagcgaattacatttctcattgtcatgagcgagtgccggatcttgcagggcataaagcatatgtttcagttcttccgtgacaatcgcatacttgaagttgatcatcaacatagggacgagttcgtacagccgttcttcatctgtcacgatcttctgtgatttcgagtgatatttacttagctgataacgtacattgatcaagtccacgctcaaccggctgatggtctggtcgggatgtgccaggaaatagcgttccgcgataaaaccggcatcgtgtatatgcgtggcggcttctgtcagaatctgtcggtgcaacggattatggaaagccaggtcgtcttccttcagatcattcaccacatattcgataacggttaccggaatttcatttccttcttcgtcggtaaggttgcacatcactttttcaccataacggactactgcctgcaggatcaatcgctcaaacttatagaactcctgaccttcttttccttcctgcggaataaaggaggtataagaatctccgggaacagtggtatccgtagtggaggcaggtgcattgccgggaggaaatcctgctgcacctcctgtagcagcggacatcggatctgcgaaagatacgatattgccatcgtcatcatattcgggttccggtggcattcctgcattggcgtagggacttgatggagtagaataagtcggagcaccggaataagccggtgtgccggaagcggcagctgtaccggaagtatctccggttgttgaagatgaatgattatagctgggacgattggctttttcagcctgcgcctctcttaatttggcgacttccgctaccagcagtttttcttcgatgcgcagatgttggctgcattctttgatgtagacatcccgtataatggcttccggtatgacggaaatgcttcgtacgatattcgaaatcagttccgcgcgtttgatcggatctcttcccgcgtcttccatcagaaggtcggtcttgaagcggatgaaatctttctcgtgctcacggatgaatgcctggaattcttccgaattatgtttgcgggcgaaggagtccgggtcgtctccgtccggaagcaggcatactttgatgttcatgccttcttccagcagcatatcgattccgcggatagaggctttgataccggctacgtcaccgtcatagagtacggtaatgttattggtgaaacggtggatcagacgaatctgtcccggcgtcaatgcggtgcccgatgaagcgactacgttttctatgcccgactggtgcatggagataacgtccgtgtatccttccacaaggaaacatctgtcctgcctgacaatcgcctgtttggcaaaatagattccgtatagctcgttactcttgtggtaaatttccgactcgggagagttgacatatttcacctttacccctttggtggcggtgctgagcacacgtccgccgaaggcgaccacctttccggaaagggtatggacggggaaaatcacacgtccccagaagcggtcacgaagacggtggtcatccgtttcgtagcagattcccgttttcaccaggaattctttcttgtagcctttgcgcaatgcttcttgtgacatggcatcatggctttccgtacagtaacccaactggaatttctcaatgatgtcatcacgaaatccacgctgacggaaataagccagaccgatgctgcgcccgtccacatgattctttaagatattctgaaagtaatcgcgggcgaagttgttgacaatgaacatactttcgcgcgttgtctgcgcctgtttctcttcattggtcagctcccgttctttgatttcgatgttgtatttcttggcgagatatttcagtgcctcgtaatacgacatctgttcgtgctccatgatgaagtggaccgagtttccgcccttaccgcagctgaaacacttgcaaagtcctttggcaggggagacgctgaatgacggagtcttttcgttgtggaacgggcacagacctacatagttcactccgcgtttgcgcagggtgacaaactcagacactacatctacaatctgtgcggcatctaaaattcggtctatggtaacttgatctatcattcttcttttctcctgtgattccgtttttgcggatacaaaggtacatataaaaaaatcccctgcaaagaactttcttgcaggggatggttaaatcttatcgaaggagaggatgatttacttgatcttttcccgaatcttggtgaggtaggctttcataccttccgcatctttcttttcgatgatttcgagaagattcttcagctctgtacggatattggccacttgtcccggggtgcgtgggttgaacaggatttcctgcagcaggtagtcatcttcgctcagcagcccctttgcgatagccatgtgcttcttgaaagttgttcccggagcttcctgatgcttcatcacggcagcaaatacgaaagtcgaaacgaatgggatggagagcgagtatgccaccgtttcatcatgttcgtcgaacgtatattcgaagatgttcaggcgcagcgtctggtaaaggtctttgaagaaaatctttcccaaatgatctccttcgctgatgataatcgcattctcgctgctcagattgctgagactggcaaacgtcggtccgaacatagggtgactggaaacgtagcggaatccgctttcttcgtagaacttcttcagtcctgtctttacggaagcgatgtcactgatgatacagtctttgggcagcacaggcaataccttgcggaaagcatccagcgtgtattttacggtgacggcattgatgaccagttcgggttcgaattctttgatttcctccagtgtggtgaaacgatacgtgttatacacgaaacgcaactggtgcgggttgacgtcaaacacggccgtctcgtgctgaaaactcagtatatccgtaaagaaggaacccattttaccggctccgaggattaatattctcatatctattattattggggagtttctcaaaagtcaatagtatctctaaaagttaatagtatctcacattggggtgactaacaagtcgattctatctttattctcctccttccagaaggaggagagttaagatactaccgactttctagtcggtctcagttgtgttactgctgacttatttgttagtttccatttgatttttgagttcttttgggctttttatttattaataatctctatctgctggcggacagactcttcgtggattgcttcgaagatcagcttcataaagtctgcgctcataccgcattgttctccttgcgcaccgcgcttttccaggatttcattgtagcgtcctgcttgaagaacggtgattccgtgttcttttttgtaagtaccgatctcacgtgctacgcgcattcttttagccagttcctggatgatgttatcgtcgcattcgtcgatttgcttacgcagttggctcaggctttctgtcgtctgggtttcggtacggatcaccaataagttgaggatgtagtcgagtacatcgggcgttacctgttgagaagcgtcgctccacgcacagtccggattgcagtgactttccacgatcagaccatcgaagttcaggtccattgcctgctggcagagcggggcaaccagttcgcgttttcctccgatgtgacttgggtcacagaaaatcggcaggttaggcagacggcgacgcagttcgataggaatgtgccattgcggaaggttgcggtatatttttttgtcgtagctgctgaaaccacggtggatagctcccaaacgcttcaagcctgcgttgtggatacgttccagtgcaccgatccacaattccaggtctgggtttaccggattttttaccagcacggggatgtcgacccctttcaatgcgtcggcaatttcctgtacggcgaaaggattggctgtggtacgtgcgcctacccaaaggatgtcgattcctgctttcagacattcgtaaacgtgtttggcagtcgctacttcggtagaaacatacatacctgtttctttcttcacttccttcagccaggcaagtccttccacaccgattccttcgaaacctcccggtttggtacgcggtttccagataccggcacggtatatcttttgtcctttggctgccagttgtttggcggtttccattacttgttcttcagtctctgcgctacacgggccggcgataacaatcggtcttttggcttcgatgcccggtaataaaattgattcgagttccatattcttattgtttttattttattcttgttcttactctttcgggcaggcgtttcctggtctgccgctgatttacttttatcggtcttttctttttaagaaagcttcttgattctttccaatgcttccgccagtttggcatccttgcaacaaagggaaatacggataaaccttgctccgttgctgccaaagatgaatcccggcgtgataaatacccttgcctggtgcaatactttttcggtcagttcttctacatccttgcacgaagcgggaatctttccccaaaggaacatacccacctggttttcgtcgtaggtacaccccagtgttttcatgatttcgccggccagatggcgacggccgcgatagttgtggttgttaccttcgtaccagtccgcttcggcttccagagctgtggcggctgccagttgcatggcacggaacataccgctgtcgatattgctttttactttcagtatccattgtacgaattcggcattcgaagccagcattccgatacgccatcccggcatattgtggctcttgctcatggagttgaattcgatgcagcactctttggctcccggtacgctgagaatactgatcggcttttcgttcaggataaagctgtacgggttgtcattcacgatgacgatattcttgcggcgtgcgaagtctaccagacgttcgtagagttccggagtggcgttggctcctgtcggcatattcggatagttggtccacattagtttcacgcggctcaggtccatcttttccaatgtttcgaaatcgggcatccagccgtcttcttctttcaggtcgtagctgattacttccgcaccgagtattttactcagagaagtataggtggggtatcccggattcggcaccagtacctgttcgcccggattgacaaaagccagtgtgacgtgaagaataccttctttggaaccgatcagcggctgtatttccgtattcggattcagttccactccataccagcgttgataccaggctgcgaaacctttacggagttccggtatgcccacatacggttggtaaccgtgtccgttgggatcgtgagcattgttgcacaatgtttcgatggtaacctttgaaggaggcatatcgggacttccgatacccagactgataacgtcttttccttctgcattcatttgtgctacctctttcagcttctttgagaagtagtattcgctgacacttgccagtctttcggcaggagcgattttatacgtttgactttccttctgcatattcgcctaatattttaagttctttggttaatggagtaattgctgctatagattgtttatatctcagataatcattgaaagatacatcgacgtaaaactggtattcccattcccgtccgatgatcggcagcgattgtatctttgtcagattgatgttgtagaacgaaagaatggataatacttgcgacaggcttccttctgtgtgtggcaatgtgaataccatgcttgccttgttggtcgcctttgcgtgatgctggcggagttcgtccacttgccacggatcggcaactaccagaaaacgggtgaagttgtgcttgttggtttcgatgccttcttggagcactttcattccgtagcgttctgccgccgttttcgagcaaatggctgcatgccctttcaggttttctttcttgatgatttccgcgctgcgtgccgtatcttctccttccactactttgagttgcggatgctgattcagaaaatcacggcattgcatcagggcgatagggtgggagttgacttctgtcaggtcttcccagctttcttcgggcaggcagacgaagctatgtgagatgcgcagcttgtattcgccgataatctgcgtaccgctttgtctcaacagttcattgttgtgcagcaggcttcccgctatcgtattttcgatggctagcattccgatgacctggctgtctttccgtatcgaagtaaacacgtcttcgaagttggcacaacagattaactctatttcttctccctcgaagtacttgtgtgcggcgatatcgtgatatgagccgagtgttccttgaattgctatctttttcattgttctaatagggttatataaaaaaatcccgcgtccatatggaagcgggatttatatgattaatttcttcatctcagtccttaagcatcatgtcacttgatacatacaaactcccgctctactttctggctaaagtaaaagtaaaaaaagaagtaatatgcataagaaaatgatttcatacgaatctttgtttctgctttggtttctaattctggggcaaaagtaataattttctgttagatgcgaacaaaaagcgatactttttttgttttcttctctaaaaaagatgaaaaggtcacctgatatgacagtaatgtttcagttaaaaatgagtatataccgccgtctgcctagaagattcccgggagtgcttccggtttcggtcccaggttcttgaattctccgttcagactagcttcgtcttttggattcagctccagtgacttcttcatgtcttctacggaaccgtctttatcaccgttcagtagtttggcgcgtccgcgttctttataggcttcggcgaagttcgggttcaactcgatggcttcgtcaaacagggcgattgcttccgccagtttcttctgattgatataaagctgtcctagatagagataggcttgttcgttgaatgggtttatttccgttacgaacttgtagtccgtttccgcttcttcttcctgtccgttggcttctttcaccttgccacgcagcaggatggcggtctcttcttccggattctgggcgagtacggcgtctatgtcttccattgtttccttgtattgcttcattttcagcagagcttccgcacgcatcagacgggcttcgatgaagtcgtctttcagagtgatggctttcgtcagatgagcgatggtcatgatttcgtcatcctgtcctttgcgggcttttccgaggagaaagtgtgcgactgcatttccctcttcgatggcgattgctttgccggcagcctcttccattgctttgtaatcttcttggatgtagcagacattggccagtgtgaggaatgtgctggtcacatgaggttccattactgccattttctccagaagttcgcgggctttttcggtttctcccatcgggatgtaaagttggctgagatagcccatcgtttcgaaatcctcttcgatggcaagcgcctcggtaaagcactttatggcataatccggacgtcccatgcgttgtgcacgcaaaccgtcatatttgaatatctcgaagtttttctgatcgtttttctgtttttcactctccggagtttcggacttaccggagaaaaaagacttaaaaaagttcggcatgatagtgttgttttagagtttatctgcaaatgtaataacttattttgaaatatgtagcattccgtcctgcatcttcagctcgccttcgtccaataaatatcggattacttgtccgatatcctctttttccgcctttatctgatcggctgtttcggcaggagtgagagggctgtggctgagtaagtcgagtatttgccttttcacttcttcgtaagattcctcggataagttgtcggtggcacgcttgctgaggcagacatcgcattgcccgcagttgtgttcgtttttctctccgaagtagcggagaagcatccggctccggcatatgttttcggtggtgacgtattcttccattgccttgatgcgtgcttcatagcgggctttgcgctcttcgtagacgctggcgggaatatgcaggaagcgtaattccagtcgttcgcgcgtatatataatataaggtgtctttttgcggggaatgtagtccacgatacggcgtttggttaacgtcaccaatatattatagatttgctggcgtgtcagtccggtgcggacggcaagagactcttcgctgatgtaggcataatcggtgaaaactcctgtgtatgagcgaagaatactctgtatcagagcttccgcctcctttcccatctcccgcaacttgtatagttcgtcccgacggatggtaaagagaatccgtgatgaattatcctgttcgtccgtgtattccagatagcctgcctgagtcagtattttcaaggcactgtctaccggcaccggaaagtatttgaacttccggcagaactcttccagattgaattcacggatacattgaaaaccgtcgcccatcgccatttggtaatagtactggagatgttcgtagacattcagaatgtactctttgtcggggaaggtgtcgaccactcgtttatggagtgttgtcttgtccgatttggagtacaggatgacggcataggctttctctccgtctcttccggcacgtccggcttcctgaaagtaggcttcgggagagtcaggcaggtcgagatgcagcacgatgcggacatccggcttgtcgatacccatgccgaaggcattggttgccaccatgacgcggacttctccgctttgccagcgtttctgccggaggtctttgacggcgttatccagtccggcatgatagaagtcggcggttataccttcgttcatcagcagttcagtgatttctttggtacggcgtctgttgcggacatagatgatggcactgcctgatattcgttgcaggatatataggagttctttcgttttgttgtcggttttgcgcacgatatatgccagattcttccgttcaaagctcattcggaagacatttccttcccggaatttcagacgggcctgaatatctgttacgacttccggagtggccgtagctgtcagtgccagtaccggaacttccggcaatagttcccgtatctctgcaattttcagatatgccgggcggaagtcgtatccccattgtgagatacagtggctttcgtctaccgtaatcatggagactttcatcgaacgcaacttggtgcggaatatttccgtatccagccgttccggagaaatataaaggaatttgtaattgccgaagatgcagttttcgagtgcggtaagtatttcctgccgcgtcatgcccgaatagatggcaagagctttgatttcccgcttccgcagattctgcacctgatctttcatcagggcgataagcggggtgatgacgatacaaatgccctcttgggcgagagcgggcacttgaaatgtaatagacttaccgcctccggtaggcatcagtcccagtgtgtctttgccttcgccgatactggtgatgatctcctcctgcaagtcgcggaaggagtcataaccccagtattgttttaatatctcctgatacttattcaatcggctttatatcctcgatttgaagttggacttcgccacgcttgtgcgtgttctcctcgatcgtatagcagatgtcgaatgaacgcttcgtcttgatatagcgcacatgagaactctgtccgaatgcgatgccgttcatgacgttattcgacttgttgtcaaccagttccagcttgatatgttcctgatcgcgtcccactactttgctggttccgtagtcatagacgtgatgcgtacagaagatcggtttgatattgtccggaccgaaagggttgaatttcttcaggtcattgaagaatttcgatgtgatgtctctgaagtcgatctccgcatctatattgatgacggcgctggtttgttccggcagaatatgttgtgacacatattcttcaaatcgtcgggtaaaggcttccacattctccactttcatggataaccccgctgcataggtatgtccgccgaagttctccaacaggtcgcggcaatgttcaatcgctttgtacacatcaaatccggagacggaacgtgcggaaccggtggccatatcatccgtccgtgtgagtactactgccgggcggtagtaaacttctgtcagacgggatgctacgatgccgatgacacctttgtgccattcctcattataaagcacgatggaacggcgttcggacagcccttccagattggccacaatattgttagcttcttctgtcatgctcttgtcgaggtctttccgggtttcgttgtactgattgatctgtcccgctttctccagtgcggcagaaaagtccttctctgtgaggaggtccaccgcttccttaccgttctggatgcgtcccgatgcgttgatacgtggtccgattttgaacacgatatcgctgacggtgatctccttttcggagagtccgcatacatcgatgatggctttcatgccgacgctggggttgctgttaagttgcttcaggccgtgataggcgagaatacggttttcgcccatgatcgggacgatgtccgatgcaatgctcaccgctacgaggtcgagcaatggaatcagatgatgaaattcaataccattgttgatagcaaatgcctgcataaacttaaaaccaactccgcaaccggaaaggtgggtgtatggataagtgttgtccaggcgtttggcattcaggattgcgacggcaggggggaggatatcgtccggcacatgatggtcgcagatgataaagtcgattcccttttctttcgcatacgttatttcctccactgctttgattccgcagtcgagtacgatgatcaatcctacgccggtctctgaggcatagtcaactccttttttagaaatgccatacccttcgttgtagcggtcgggtatgtaatagtcaatgttcgaatagaactgttgaataaacttgtagaccagtgctacggcagtagtaccgtctacatcataatctccataaatcagaatacgctctttctttcccatcgccttgttcagacgttctactgcaatgtccatgtccttcatcaggaacggatcgtgcaggtcgggcaattgcgggcggaaaaacttcttggcatctcctgccttcgttattccccgctgcaccaaaagttgtccaagtatcgggctaatgcctaattcctgggccaatgtctggcttgtctctgcctgttcgggtgtaatgggttgataattccatttgtgattcattttatatattgttttttctttttctgttctcaggggtcagaaaggcgctactttccaacaaggggtaaaagtacgaaaaaaagcggaagggtatagtagatatgacgaaaatatttcaaaacctgtggaattagctccttacgggcttggtattcaaatggagcaaatgcatacagatttgaatcaaccgctgattcgcattaatagctaataaagcgaaaataaaaattaagtccgaagattattctcctcataacatcataaggtattcagttatatgacacaaaaagagaaaggtagtattgtagcaataattcatcgatttacctagaaaataaagaacttttcaaaatcagcaccaacatctatacgaaagactttgactaattatgcagtaacctccaatcatttattaataaattatttcatcgtttattataaacgtcctccaagtttattataaactcggatttcgttattcctgcaataaatattaatattaagcaacaaaaagggccgcaattcccataaagaatcgcaacccttagcttgtatcagactatccaacaagcattacccggagtgggaatgcctgcaatctgttattatataatacttattattgctcatatttcgtctatattatcaatgttatcgaatttacttccggttgttatgtaggtcagcggcgtttccgccgctttccccattaagaactgtacgtgcaatatttcatctttattttcgatttttgaagtgtcaacttattcagtacactacaggaaacatatcaagagaagggacccaatgaaaatcatctattataatgataatattatttaggcacggattgcacgaatttcacggtctttaattgaatagaaccgtgttaatccgtgaaatccgtgcctaaatgaaaataaatagtgttttgattacatattcgtgcagtcaattctttatttatatccggcagctttagctatccgtttcggaatttccgtattgtcaatcttctcaccgaacagttgagaaccggcaccgatagcaaataccggcacataaccggcagagtgaccgccgcttacccagcctaccatagatatctggtccattacttctttagcgcgtgcagccatcggctcgcttttagagtacatgctttcggcaaataccactttatttctgacaaaggattgttcgaactcgtcacgcagcttcttttcctgttcccaggaaatagggaactgtttccagaagcccatttcttcacccaggaattctttcatgtcttcccaagtcactttgttgccttttgattttcttagttcgctgatacgtctggacaatccgtcagcagaatgtttttgatattgcaatgctttcaggttcaacgcatatttgcctgtacctagtacgataccaccggtttcgtggtcggccgtaacaacgatcagtgtttctttcggatgtttcttgtagaattcgtaagctactttgatagcgtcatccatgtcctttacttcattgaatacggtagcggcgtcattaccgtggcaagcccagtcaatctttccaccttctaccattaagaagaatcctttgttcttgcctttggtcaggaagtcgattgcgctttctgtgatttgggcgagagtcaagtcgtcgcttttacggtcgatagcataaggcaggcaggatggatctttgccttcttcctgtatcaggatcattttgccggcatccttgcttttggctttataatcgctgtagccacgtgctacggtgtaacctgcttcttcgaaaatagggaagatgttgggagcgtctttcttgtcatacgtcttgtccggtttcagaaaaccaccgcctgcatagaagtcaaagtttgcttttgtcaggtcgacagcgatttcataattcatattacggtctgcctgatgagcgtagaaagcggcaggagtggcgtggtctacgctgacggaagtagtgacacctactttctttccggccttcttggctttttcggctacggtttcaatcgggtttttgtcttctcctacagagatggcactgttgtaggtcttctttccggtagccagtgcagtacccgcagcggcagagtcggtaacagagtttgtcgcggagaaagtggttgccatcgttgctaccggaaattgggtgaacaataaaggttcaacgccgatgcgcccgttttgcagttctgcctgatacatctctgtaccatttacctgattgactcccattccgtctccgatgaaatagaatacatactttgcctgctgaccgttggctgcaacggaaataaggacaaagagcagtgtgtaaatcaactttttcattcttttgtatcttaatattagggttagtgatggacaaaggtaataaaaaacggtggaagtgccgaagcaaatccaccgtttctttatgtcatttgtatgacatttatgcttttacgcgtcctacgtaagaaccgtcacgagtgtcgatttcaattgtttcaccttcgctgatgaacaaaggcacacgtactgttgcacctgattctacggtagcaggtttcagtgtgttggtggctgtatcacctttcattcccggttctgtataagtaaccttcatctgaactttgatcggcatgtctgcataaagtacagtttcggtagaagcgtcagaaacaacgtccagcactgcaccttcgagcaagaagtctacaccattgatcaggtcgtgagcgatggggtgttggtcaaaagtttcctggttcatgaagatatagtcttctccttctttatacaggaattggtatggacgacgttcaacgcgtacatcttccagtttttcaccgatattgaaacggcgttcgagaacataaccgcttactacgtctttcagcttggtacgcataaatgtgttacctttacctggttttacatgcaggaattctatacagaaatagagctttccgtccatacggatacaagttccgtttttgatgtcttgagcattaatcatactgctgtttttcttattatattattgttatttaattgtcttcgtcgtaattcgagtgcaaaagtaatctaaatcagtaaaaaacacaaaaacttttgagcaaaaatgacttatcgcttggttaatttaaaaaaagtctctatttttgcagcccgattacgtagaataataacataaaaacaagatacagtaatgaaaagaacatttcaaccctctaacagaaagagaaagaacaaacacggtttccgtgagagaatggcatcggctaatggtcgtagagtattagctgctcgccgtgcgaaaggcagaaagaaactgactgtttctgatgagtacaacggacagaagtggtaatcatcactcagaaacaaaaaaggcggagttttaaactccgccttttttgtttgcttctattttcattaaagttggttataacttcctttttatgataaaaagtacaggactcttggcacagtagttaaatagagtattaaataatgtttaatggaatgctctttgtcactttttagctttctttgtcacagatcatagacggaatatatgcgacagacggttgtgctcagagaatccggaagccgcatcctagaatataaggttgttgaaatctataggagtggggaatatagttgcaacaattgtggtgatgacaggtgtccttgcatttatgcagggacattttcattgcccactattccgaaattcaactaatttgtagtatctttggcgcggattaacagcaaagcgtatgacaatcaaagaattcttttcttttaaaacaaataaatatttctgggtgaatatccttgtcatgattgtggcagtggtgctgattgtgttcggcgtgatgaaatggctggatgtttatactcgtcacggtgaggcggtggttgtgcccgatgtaaaagggatgactgtggatgaagcttcaaaaatgttccgcaatcacggattggtatgtgtcgtttccgattctaattatgtgaagaatatggcagctggcattgtacttgatgtcaacccgggaatcggacaaaaagtgaaagaaggccgcaccatttacctgactatcaatacactgagtattcctttacgtgctgttcccgatgtggcggacaacagttctctgcgccaggcacaggcgaaagtgcttgctgccggattcaagctgaccgagattcagttgatgaacggtgagaaggactgggtgtacggcattaaatatcaggggcgctcattgaatgcgggagataaagtacctttgggagctgcattgacactgatggtaggaaacggagaaaacgaaccgttggaaagcgactccatggaaaatgttgaaggggcagatgaacctgtttcctcagaatccccttcaagtcaggatgatagttggttttaattgataaataacgaaacagattcacatgatcgaggaagaacttccggatgaactggagaatgatttggatgatatagaacctgtcggtgacgaatcccagctttacgaacattttcgggtggtcgtagacaagggacaggcgatggtcagagtcgacaaatatctgttcgaacgtattgtcaatgcttcgcgcaaccgtattcagaaggctgccgaagatggattcgtcatggctaacggtaagccggtgaagagcagctacaaggttaagccgctcgatgtcattaccgtcatgatggaccgtcctcgttatgagaacgagattattcccgaaaatatcccccttaatatcgtttacgaagatccatatgtaatggtagtgaacaagcctgcgggactggtagtacatccgggacacggaaactatcacggtacgcttgtcaatgcgttggcatggcacatgaaagatattcctgaatatgatgccaatgacccgcacgtcggcctggtccaccggattgataaagatacgtccggtctgctggtgattgccaagacgccggatgccaagaccaacctcggaatacaattctttaataagacgaccaaacgcagataccgtgcccttgtctggggaaatgtggaacaggatgaaggcacgattgtaggcagtatcgcccgtaatccgaaagaccggatgcagatggcggttatgtccgacccgtcgatgggcaagcacgcggtcactcattatcgggtgcttgaacggctgggatatgtcacgctggtagagtgcatactcgaaaccggacgtactcatcagattcgtgtccacatgaaacatatcgggcatgtacttttcaatgacgaacgctatggcggtcacgaaattctgaaaggtactcactttagtaaatacaaacaatttgtaaataattgctttgacacttgtccccggcaggctctgcatgccatgacattggggttcgtacatcccgtcacaggcgaagagatgtactttacttccgaacttccggatgacatgacccggcttatcgagaagtggcgaggctatataagtaacagagaaatagaatgaaacgcacaattgctatcgtagccggaggtgacacctccgaatttcatgtatccctgcgtagtgcacagggaatatattccttcatagataaggaaaagtacacactgtacattgtcgagatgcaggggacccgttgggaagtacaattgccggatggtgcaaaagcaccggtagaccgcaatgatttcagctttatgctgggaacggaaaagatcaggtttgactttgcctatattaccattcacggtactccgggcgaagacggccgtcttcagggatactttgacatgatgcacataccatactcttgttgcggggtgctggctgcggcgatcacctatgacaagtttacctgcaaccaatacctgaaagccttcggagtgcgtattgcagaatcgttgctattgcgtcagggacaatcggtttccgacgaagatgtgatggaaaagatcggtttgccttgtttcatcaagccgagtctgggcggttcgagcttcggtgtaacaaaggttaagacgaaagaacaaatacagccggccattgttaaggcctttgaagaagcccaggaagtgctcgtagaagcattcatggaaggaacggagctaacctgcggctgctataaaaccaaagacaagaccgtcatcttcccgcctacggaagtggtgacacataatgagttctttgattatgatgcaaaatacaatggtcaggtagacgagattactcctgcacgcatctcggacgaactgacgaatcgcgtgcaaatgctgacctcggccatttatgacatattgggctgttccggtatcatccgtgtggattatattgtgactgccggcgaaaagatcaatctgctggaagtgaatacaactccggggatgaccactacaagctttattccccagcaagtgcgtgctgccggactggatataaaggatgtgatgactgatataatagaaaataaattttaggtattaagtattaggtaataagtattaattccatgcggtttacagcgcagcctaatacttaatacctaatacttatttataaacttcatagcttatggatactacagagtttgatgagattcgtccttataatgatgaggaacttcctcaaatctttgaggagctgattgctgatcctgcttttcagaaggcggctactgatgcgataccgaacgtcccctttgaacttttggcgcagaaaatacgtgcctgtaagagcaagctggattttcaggaaacattctgttatggtattttatggaaaatagcggcggaccatacggatgggctgactctggatcatacggctgtgccggataagagcaaggcttatacatatctctccaatcatcgggatattatattggattcgggcttcctctctatcttgctgatcgatcaggggatggatacggttgagatagcgattggtgacaatctgctggtttatccgtggatcaagaagctggtgcgtgtcaacaagtcgtttattgtacaacgggcgctgactatgcggcagatgctggaatcttcggcacggatgtcccgttatatgcattataccattagtgagaagaagcagtccatctggattgcccagcgcgaaggacgtgccaaagactcgaacgaccgtactcaggacagcgtgctgaagatgctggcgatgggtggtgaaggtgacttgatcgaccgtttgatggagatgaacatcgctcctcttgccatttcgtacgaatatgacccctgtgactttctgaaagcgcaggagtttcagttgaaaagagatatagaaggatataagaaaaccactcaggacgatttgatcagtatgcagaccggtcttttcggatacaaagggaaagtgcattttcagacggctccctgtatcaatgacaggttggcgcagctggaccgttcgttaccgaagcaggaactgttctccagcatatctgcctgcatcgaccagaggattcatagtaactatcggatctattcgggcaattacgttgcctatgacttgctgaagggtacatccgagtttgccggtcattacactcccgaagagaaacaacgattcgttacctatatcgagcaacaactgggcaaaataaagattccgaataaagacgaagactttttgcgtggaaaattgttattaatgtatgccaatccgttggtgaactatttagctgcttgccaatgaataaagtaaagttacatacactctggcttttgggaatgcttttcctgatgactgcctgcggggatgatgattactattatccttctgtgaagttggaatttgtcacagtgaaggctggggcggatggtctgatacagagtctgcttcctgacaagggagagctgttgactgttgcgaaagaccgtaccggatcaaccatttctccgaactcggctaggcgtgtgatcagtaactatgaagtaaatccggaggatgctacggctgtcatatactcattgcagtcggtggtgacaccggagccaaagggggctgacgatccggctttcgaaggcggactgaagtatgatccggtagatgtgaccagcatttggctggggcgtgactatttgaatatgattctgaacgtgaagatcaatatcaatagtggcaaacagcacgtgtttggtatgatagaagagagcgttgaggcggaaggggatgagacagtcgtaaccttgtctctgtttcatgatgcgaatggggatgaggagaactataatcgccgtgcctacatttctgttcctctgacgaaatatgtggatgaagaaaatcctcatcaaaccataaggataaaattcaagtatcataccacagataaaagtggtgtggtggtagaatcaagcaagtattgtgatccgggatttgaatatgttccgggcgtgaactgattaagatagtacatatgtttaaaatgaatcaattagtcgtgggattatttttatttctctcttctcttttctcctgtcagcagaaaggagactttaaaacggtgaatgtagaggatttcgattctatcattcaggatgaagaagtgcagcgtctggatgttcggacactggctgaatattcagaaggacatattgcaaaaacgatcaatataaatgtgatggatgactcttttgcctcgatggcggattcattgttgcaaaagaacaaaccggttgcgttgtattgccgtagcggtaaacggagcaagaaagctgctgcgatccttagtgaaaaaggatataaggttgtggagcttggtaaaggattcaatgcctggcaggcggcaggaaaggagatagaatactaaggttgttgtacggctttttactgtctattctagaataaatggttacgctctacatgaaattctgaagggatgcaatcgttatcgtgctagtatacaatcaaatatatgttgctatattctcaatgtattctcatgcttatgagaaaaagttctcaccacaatgagaaaagattctcatacctatgagaaaaatttctcaaaggcatgagaatcttttctcataggtgcgagaataaaagtaaggtttcattcacagatgttccgtttactccaatccctcaatcaatctcttcaaaaccaccgtagccgagatttcacggttggcagcttcggggataacgatagactggggactttcgattacatcatccgtaacgatcatatttctgcgaacaggcaggcagtgcataaagaaagcattgttggttactgccatctgtcggtcgctgactgtccattcacggtctttgcttaatatctggccgtaattgtcgcctgtataggcagcccagttcttggcgtatataaagtctgctccttcgaaagccttcatctgatcatattctaccttggcatttcctacgaattgaggtgccagctcatatccttccgggtgagtgataacgaaatcatagtcagtggcattcatccactctgcaaaggagttgggaacagcctgcggcaatggacggggatgcggagcccaagtcattacgactttgggacgtgccgtctttttatattcctcaatggtgattaaatcggcaaagctctgcaatgggtggcgggtagctgcctccatcgagaagacaggacgtccggaatattggataaattgattcagaatagtctcctgatagtcaaaatcacgatcttcgaaacgggcaaaggaacgtactccgatgatgtcacaataacaacccatcacaggaatcgcttccagcagatgttccggtttgtcaccatccatgatgacgccacgttctgtttccagtttccatgcaccttggttgatgtccagcaccattacattcattcccagattgagagcagctttctgtgtgctgaggcgggtgcggaggctggagttaaagaagatcatcatcaatgtcttgtttcgtcccaactctacatatttgaagcggtctttttgaatttcaaatgcttctgcaagggctgattttaaatcgccgatgtcctgtacacaagtaaatttcttcattttatctatcattaatcgttattgtccaattgatcatttgtcgtttcctcactttaccatctggtctgtccgtcgccttcgatcacccatttgtaggaagtgatttcctccagtcccatcggaccgcgggcatgcagcttttgagtactgatgccgatttcagctcccaagccgaattgtgcaccgtcggtgaaggcggtagatacgttggtatatacgcatgccgcatctactatcttagtaaacaaggcggcacgctctttgttttcggtcacgatacattcgctgtgtcttgaactgttttcctgtatatgccccagtgcgtcttcaaagcttttcaccgttttgacagccatcttataatccagaaactctgttccgaagctttccggagtggtaggttgcagcaattcagccggataatatccttccagtgcctgataagcctgtgtatctgcatagatagtaaccttgctttctttcagttgatcacagagcgcaggcaaatcccccagacgtttctcatgaatgatggtgcagtcgagcgcattgcagacactgacacggcgtgtcttggcattatggataatatccgctcctttccgggtatctccgaactcatcaaaataagtatggcagatacctgctcctgtttcaatgacaggaatccgtgcattctcgcgcacgaaatttatcagattgctgcttcctctcggaataatcaggtctacatagcctactgcattcagtaatgctgccgtagcctctctgtctgccgggagcagttctactatatgcgggttgacatgaaacttttcaagtaccttgtgaatgacactgataatggcacggttggaatcgtctgcgtcacttccacctttcaggatacaggcatttccacttttcaggcaaagggaaaagacgtcgaagctgacattaggacgcgcttcatagatgatgcctattactccgaaggggacactgactttggtcagcttcattccattggggcgggaggtctcctttaatattcttcccagcggggaggggagagttgctacattacgtgtgtcggcagcgatgcctttcagcctctcttccgtcagttttaaccggtcgtacttcgggttactcttgtccatccgtgccaggtccttttcattttctgacaggataaaaggtgtttcggcaatggcagcatcagcgaccgcattcagtatctgattgatggtgtcgtcactcagcaatgccaattcccggctggcagcttgtacagcagcgaaagttccgtttaaatttgtagtcatttgctcctttttacgttttatattttttattcgatatacagatagtcgtaatgtactacaggctttttgccatgtttgcccattgcttccctggcctgtgcggaatcgcagtttgcttttcctacaccaacctgattgcccaggaagtccatgatgcgtacaatatcgtctttctcaaattcgccttcgatgtgggtgattccgaccggaagaatgctggctgccttctccgaactgaggatatccgtggcacattcgttaatatgaatttcccctttggcgaatccttcgctgtgggcaatccatttctttacactggataccgcctcggtggaagggataaagcgcgtgcaaactgtatcgtccggctgttgcaacaagtctacgagaatattatcccgttttccgttggcgataatgaccgtaatcccttcgtcggctaccttgcgggcaatattcgttttcgtcagcataccgccgcgaccgaagctcgatttggtagcctggatatagttggataaatcctttccatgctcgatctcccgaatgacagcggaggcaggatcggaaggtgaaccgttgtagattccgtctatgttactcaggataatcagtgcctgcgcatccatcatggaagcgatcagtccggaaagctcgtcattgtccgtgaacataagctcgctgaccgaaatcgtatcattctcattgacgatggggatgacgccgttttcgagcatcaccgtcatacagttcttctgattcagataatggcggcgggtactgaagttctctttggtagtcagcacctgacctactgcaatgccgtgttcacggaaaagttcgtagtagcggtttattaatttagcctgtcctacggcggagaataactggcgctggtctacactgtcgagctttttctgtgggtgtatttcgctgcgtcccgaagcaactgctcccgaagaaatgagaatgatctctactccggatttatttaattctgctatctggtcaacgagtgccgacatacgggtgacgtccaatgtaccgtcacggcgtgccaatacgttactgcctacttttactgctattcgtgtaaactcttgtttcatccttactaacgatttgaaagcacaaatatagagctttttgtcgatatgttacaaaaacaggctgaaaagaattatctttgcagcctgacagataaaagaaaaacaatgaaacatacgaatccccaagtagaacaaatgacctcctttatcgtgatggatgtattggagcgtgcaaatgaattacagaaacaaggtgtggacgttatccacctggaagtcggtgagccggactttgacgttccggcttgtgtggcggaagctgctaaagctgcctacgaccggcatctcacacattatactcactctttgggggatccggaactgcgtcgtgaaatagccgctttttatcaacgtgaatatggagtcaccgtcgatccggattgtattgtcgtcacttccggttcttctccgtctatccttctggtcttgatgttgctttgcaactcggacagtgaagtgattctctccaatccgggatatgcgtgttatcgtaacttcgtgttggccgcccaggcaaaacctgtcttggtgcctctgtccgaagagaatggtttgcaatatgatatagaggcgatccgtaagtgcgttactccgcatacggcaggtatttttattaattcgccgatgaatccgacgggtatgctgttggatgatagtttcctgaaaagtgtggcatctttgggcgttcctattatttcggatgagatctatcacggactggtatacgaaggacgtgcgcatagtattctggagtatacggataaggcttttgtcctgaacggattttccaaacggtttgcgatgacagggctgcgcttaggttatctgatagcaccgaaatcctgcatgcgttctttgcagaagttgcagcagaatctgtttatctgtgcgtccagcatcgctcagcaagcgggaattgccgcattgcgacaggctgactcggatgtggtacggatgaaacagatctatgatgaacgccgccggtatatgatcagccgtcttcgggaaatgggattcgagattaaagttgagcctcagggtgccttttatattttcgctgatgcacgtaagttcactaccgactcttatcgctttgcattcgatgttctcgaaaatgcgcatgtcggcatcactcccggtatagactttggaacgggaggcgaaggatatgttcgtttctcctatgcgaattcgctggagaatatccgggaaggactggaccgtatcagtcagtatctttctcgttgcggcttctgatcagttcagtagcggcttcgtactggtcttcagtgaccagaacagatacagatggagcaatatagggggctaatgtccccatgataccatctttaatgacgcagcggatgtcattactttccaacaatcccttgataatttctgcttcccatggcgaaccggagaatacttctatggccttgctataatcttcttctttcataatcttatgctatttgaggttatgtatacaaatataacaaaaaagaaggaaagattgatcagctttcccatatttattcgagagagattctttttacgtcgatttgctggttcaggaaggaagaggccgattcgacaaacttctcttccgcctctgtggtgtaaaacagacagctgccgttttgggtacacttggcattcatttccgggtgtctgctcaggtagtccttcagactttcggctacatattctccttgtgcgacaatgcggatatgcttcggagtgtattcttgtatcttagggagcaagataggataatgcgtacagcccagaatcatcgtgtcaatttcgggatctttggatagcagctggttaatgtatttccggatgaaataatcagccccttcgttctgtgattcattattttccactagcggtacccacatggggcatgccattccgctcacttgaatatccgggaatagcttatgtatctccaatggatacgattcggacttgatggtacctgctgttgccagtactccgatatgacggctttgagtaatgtcgcctatacactcaacggtagggcggataactccgagtacacggcgttcagggtcaatgccgggcaagtcattcatttgtatgctgcgcaatgctttggcagaggctgtattgcaggccaagataacgagatgacatcccatttcaaacaatttattgactgcctgcaaagtgaattcgtacacgatttcaaaagaacgtgtgccgtaaggagtgcgtgcattgtctcccagatagacataatcatattccggcagtgcctctcttatcttgttgaggatagtcagcccaccgtatccggaatcgaaaactccgattggtccgggtgtatgagatagatgttgcttcatgacgagtgcggttttatatacgcaaagttacatgaaaaaagggaaagagaaagaagtatgatcttcttttctctttccctttcggtattttatagcttatagcttcttatttgatgccgagctgtgtctttaccttaggagtcagattaatactttgtgactcattaacgtaagcaaccggtgttcttgcaaggtcgaagatgtagattacgccttcggcagcacctacagctttaattgcgtcgtccaactttttgtagataggagccattgcgtcagcctgagctttttgcatctgctgttgagcttcctgttggaactgctcttgtctttgcatcatatcctgcagttctttttgtcttctctcagcgatgttagcaggaagagagtccttagcgatagcttgctggaattcctgatatttcttgttgaattcttcctgagttctttgtaattcgctggtcagttgtttgtctagtgcttcaatatcagattgtgccttagcaaattcaggcattgctgaaacgatttcttgggcattaatatgaccgaatttcagattttgtgcaaatacacccattgggagtgcaagcatcaatacaagtgcaattttttttagcatagttctataatttatttgaatgatttttagttattttcgatgcaaatgtatgaaattaatttgaatatcctaattttctcagcacttcatcactaatatcaatacgtggattgccaaaaatgatgcctgcagtagaggctctgtcaagtacaaggtcgtatccgtgtacttgcgacagttcctttacggcaccatatatttcatcctgaataggattaatcagcttctcctgcatcttagccagttcgccttccggaccgaagtatttgcgcttcagttcggcagcggatttctctttcgctacaatctcatcttccttcttagtcttctgagccgcagagagagtagaggactgagcttgatagtcctggaacatcttctgtgcttccttggcaattacctccacttcgctttgatatttcttcgtagcttcctgcaattgctcattagcgctttgatatgccggaatatttttcagaatatattccgtatcgatcaatgcaaatttttgtgcactagctgccatactgatggcaaacagtaacataatggatagaacagactttctcatgacgtttagtttttagttttatattagaattcttgtcctaagataaagtggaactggctgccgccgtattccttactattgttaatcttatcgaaaccgtaaccccagtcgatacccatcataccaatcatcggcaagaagatacgaacaccgataccggcagaacgtttcaaatcaaacggattgaattttgagatatcatgccaagcgttaccagcttccaagaaacctaacacataaatgttagtacttgtttccagcatcaatggatatcttaattcgataccaagacgagcgtaagcatatccttcttctccgtacggtgtcaatgaactgttttcgtaaccacgcaaggcaatactttccgttgcgtagcttgagtaacctgtcataccgtcaccacctacgtcgaatgtaccgaacggtgatttcttgtatttattatagtgacctaacaaaccgaactctgtacgtgtcatcaataccagacacttaggatgtgctatataatccatcaacggagtatatgttttggctttaaatttccatttgtggtactcaacccatctatgaagtttattcatattatcctgagtgatgcctctgtcgctttcgggattatagaaataacctttatagtctttaccatcaaacaatgagtacggaggagtaagctgaactgacagcgagaagtccgaacctgtacgtgggaagatcgggttgtcaatagagttacgtgccaaagtcagtgaaaggctgaggtcattacatttaccgttggttaccgggaaatactgccagtctttcaggttgtagcgttggtaagctagctctgcagacaaagtaaagtagtcatccggccatttcagacgcttaccccaacctagagaaagtccccacatcttgatagacttatcggggtcatagtagttctcatagttgttgtaattgccatagttgtacataccatagccaccataaccgctatacatactattgtaatagttgttgaaatagcttgagttgtagtaacggctgctgatgtcagtctgaactgagaagaaagccgatacggaaagtgagttcggtcgtttacctccaaaccaaggatcgaagaatgagatactatatgactgatagtatttagcattcgtctgaccgctgatggtcaatgtctgtccgtcaccttgcggcaggataccacggtagttttcacccggacgcaacaagttggcaacagagaagttggtaaatttcagactcagtttaccgatgatacctgtttgtccccaaccggcagagaactctacctggtcattggctttagatgtcaaaggcagacctatatcaaccgttccgtttacagggtccggctgaatatccggctgcagtttttcagggtcaaagtgtcccatctgctggatttcacgtaatgaacgcatcaggtcatccttgctgaacaactgtcccggacgaatgcgaagctcacgacgaactacgttttcatacagacggtcgttaccgctgatgttgatcttattaatcgtagcctgacggccttcataaattctcatttcgaggtcgatggagtcgccgacgatatttacttctaccggatcaagattgtagaacaaataaccgttattataatataagttaccgattgcgtcgtcatctgtagaggttcgttctcccagcaacttctggttataaacatcacccttcttcatgcggagcaggaagttcagctgttctgaaggatacagtgtgttacctacccatgttacattacgaaggtaatatttctgaccttcgtctatatccatatatacatctaccgtcttttcgtcgtattgtgctacactgtcctttacgatcattgcatcacgatatcccagctcgttatacttatctatgatcagctgcttatctgcttcaaagttttccggaacaaatttcttggtgcggaacagattcagaagtttacctttttcattggtcttcttcatcactttcttcaacttagatgttttgatggccgagtttccggcgatatggatagcgtgcactttaatcttttccttcttgtcgatatcaatgtcaacaatcacttgattttcgttagatggatcatctttttgcgcaataatcacttctgcattcttaaagcctttatcatcaaaataacgtttgatcaatgtctttgcacggtcaacggtattcggagtgatctgcataccttttaccatacccagcttgctttcaaggtctgtacgttccgactttttcacgccatgatagcgcacatccgcaatacggggacgctgtgtcagactgatttttaaccaaatcttgttgccttctatcttttcggcagtaatctgtacgttagagaacaaaccatgtttccagtagcgcttgattgctccggtaatctcatcacccggcacggtaatcgtctgtccaacggacagtccggataatccgattaacacatagtcttcataattcttcacgccttcaaccttgatgtctgctatctcatactttttaggcgttcctgagtataagatgactggcttagagtcttcgtcagtgttggtattctgcgtaaagcccgtggctgcaaagcagaacaggcagataaacgttacgaatataaaggaaatacgataatgcatttatgttataatttgaagtttcgaattatgttagctgatttgttcactcgttttgccgaaccggcgctctctttgctgatactcataaatggctttacagaattcttctttatcgaagtccggccagaatgtgtcacaaaaataaagctccgaataagcacattgccatagcaggtagttgcttagtcggatttctcctcccgtgcggatcagtaaatccggatcgggcataaagtttgtggtcagatgagcagttatgtattcatctgttatttgttcaggagatatttctcccgttttcgcaagcgttgcaatctgtcggactgcttcagtcatttcccagcgggaagagtagctgagtgccagtaccagacaggttcctgtattattagctgtgtgttctatacatcttgacagaccttcctgtacttcagcaggtaatttctttatatcgccaataatgcggaaacggatattgttcttcatcagagtttcttcttcgatagaatccagcaatagattcatcaaagctgctacttcttcctgcggacggttccagttctcagtggagaaggtatataaagtcagatatttgacccccagacgtgcagcatcctcgataattttatgtaccgtttctgcgcctgcctggtgaccgtaagttcgttcttttccccgctgtttagcccatctcccattcccatccataatgatggctatgtgctggggaatccgatttttgtctattttctctatataggacatgttttgattataaggttcgtatttaactacttcttattattgtattagaaatccgagtctattaactctaccacgccagattttgtcaatgccttgaccgcctaccatccatatataatggtttctgtcaactaccattgtgtagtttgcttcttttcccttgaagctggattcgtgaagagaaggatgttgtgttattcctccttcaagtttcaccggaggaagaattccgggaagcatgaacattctgtctacccctttccatacaagtaatgtcggggaggtatagaatttctggaatcccttagcatcatcttttgtctcttttccgcaaatgtagaatgcgtcattataatgtataatggacgggtctactaatttcggacagttattatttgatggaatctccattggaatccaggatttaccatcttctgaggcccaaacgactgtagctgtgtctttctttgaatctaatccttgagtattacccacaacgattgcattcaatgttccgctttcagttgcatatacatcggctgacaggttgtttgtcgggaactcagcagggacagctgttaatttgtctatatctttctcccatgttgcatctttctctgcaaaactgaaatatttctctccattaatctctactatacctgctattccatttatctttttatggttactgccatcactgtcagaaaagctggttatcagattagtaacggaaacaccatcggaattgagtacttcatcttttgtccaagtcaaaccgtcattggaattatatacttccttattctcagcaagtaaatataacttgtcaacgaatcggataatggatgtaatatcagcaccaacaggaagttttccagtagtttctttatcccatttttgaccatagtttaaacgatcagtaggagagcctgccggtattgctgtactgtaaatttcattgttttgagcgaataataatatcttgtccccaagcgttactaccttttgtttttcagcagtgttgctcacgggattgttcgctatagggtcttttccccaactgagtgaatcgggaaccatcgtatgcatccgtatattaactttgtactcattctgaacctccatattcggtgcccataccttcagtaccagaaagttgtttttctcggttgcatttacatacttagtcaggtcaatagagtcattaatattaacgattgaatcctgatcgttctgatctttcatcgtcacgataccggatgccgtagtcagcgtcttgatcagaatactattaatgatcgtgtcagcattgacaggcagcgaatccacattatatattaaacgactaatttggtcaattgtgaatttatactttaccccgtagcctatagtgtcaagttcaaatgcgcgtatagtcgcatccggactataattgacttcgttatcgttgtcaaggcaagacgtaataacgaatgacaccatgaaaaaactcgcaatgattgataaaaactttattctcatttgaaagattgtgtttatttacaagttgcaaaaataggaacattttttccgatatagaacattaaggggaagttttatataaaattatagataataacgctgtttttatcgacgtagaaccccttgaatagaactattttagctatttctcgaaaacataatgccaaatctgtctgtcgaagtgtttttctgtcgaataactaaaattatcgcttatttcaggtgctttaacaccggaattcagtttgcacggacatttctcaatatatacttcatcccatagttcggcatcaatgaatgattggagcagttgacttcctccctctaccagtaaagactgtattttttgttgatatagcacttccatgatctgtggcagaatatcctgtgtgaagtcaatcgtacgatatgtgacgttcttcttatccggatgtttttctgctgtaaatacgatggtgagtacttctccgtcaaacagacgcaggctgtggggaagagacaatgcacggtccaaaacgatgcgtaccggattccggccgtaccagttgcggactgtcagcgacggattgtccaacaatgctgttcgcctgcctaccatgattgcatcagcctccgctctctttttatgtacaagcatggaagtaagaggggaggacagtattacgggattgccgtctgttcgttctacgtcaatgaaatgatcagccgattctgcccattttagtgtgataaaggggcggtgcagcgtattgaaagtaataaagcgccagatcagatgtttgcattccttctccagtacgcctactgtcacttctcttccggcgttccgcaacttctgaatccctcgtccggcgacctgtgagaacgggtcctgacagccgattacaatacggggaatcttttcctcgataatcaagtcggcacaaggaggcgtctttccgtagtgtgagcaaggttccaggctgacataaatggtggaacggctcaataaagacttgtctttgacggaacgaatcgcgtttacttcggcatgcgcctctccgcagcggatgtgatatccttcgccgataatacgtccgtcacatacgataacggctcctaccatcgggttcggagcaacattgcacagtccgttttttgccagctcaatgcaacgtctcatgtatttttcttcttccattttggtgctcttcgctatattattcttacttttgcactccgaaatcgtaaaatatgaaccgcatcactacttacatccgtcagtcactacaggatatttatccgccggaagaggtcaaagctctttcgatgttgatctgttgcgacatgttgggggtagatgcgcttgatatttacatgggcaaagatataattttatctgcatgcaaacagcgtgaattagaaaacattatattccgtttgcagaaaaatgagccaatacagtacatacggggatatgctgagttctgtggaaggaacttccgggtagctcccggcgtgctgatccctcgtccggagacggccgaactggtggacctgattgtgaaggagaatccggatgcacgtcgcctattagatataggtacgggaagcggatgtatcgccatctctttggataaaaatctgccggatgcgaaagtggatgcctgggacatttcggaagaagcgttggctattgcccgtaaaaataatgaagagctggatgctcaggtcaccttccgtcgacaggatgttttttctgctgacggaatacaggggacatcttacgatataattgtcagcaatccgccctatgtgacggaaactgaaaaaacagagatggaagccaatgtgcttgactgggagccggaacttgccctgtttgttcctgatgaagaccctctgcgtttctatcgctggattgcggaactgggacgagaactacttcgtccgggtggcaaactctattttgaaatcaatcaggcatacggacaagacatgatacgcatgatagaaatgaaccaatatcgggacgttcgtgttataaaagacatatttggaaaagatagaatacttacagctaaccgatgagtgcacaattaacagatgaagaggcgttgaatcgtgttgcctcttattgctccgctgcagaacattgccgggcagaagtaaatgagaaattacagcgttggggtatagcctatgagaccatagcgcgtatccttgaacggctggaaaccgaaaagtatattgatgacgagcgctattgccgtgcttttgtgaacgataagtttcgttttgccaaatggggtaaaatgaaaatagcacagggactctacatgaagaagattccttccgatgtggcatggcgtcatctgaacgaaattgatgaagaggaatatctctccatcctgcgtgacttgctggcttccaaacggaaaagcattcatgcgaaagatgattatgaactgaacggaaagctgatgcgatttgcggtgagccgtggttttgaactcaaagatatacgtcgttgtatcgaaattccggaggaagaggaacaattcagttaaaaaataaacggattcttctttctattctcgttcaatttctgtacttttgcggcaaataattaatagttagtttagttatgaaaaacttagagagactatttgcggagaaacttttgaagattaaggctattaaacttcaacccgctaacccttttacatgggcttctggatggaaatcccccttttactgtgacaaccgtaaaactctgtcctatccttctcttcgtaattttgtgaagattgagattacacgtctgatattggaacgattcggacaggtggatgcgattgcaggtgtggctacaggtgctatccctcagggagcattagtggctgacgcgttgaatctgccgttcgtgtatgttcgttctaccccgaaagaccacggattggaaaacctgattgaaggagaacttcgtccgggtatgaaagtcgtagtggttgaagatttgatttctacaggtggtagtagtttgaaggctgtggaagcaattcgtcgcgatggttgtgaagtgatcggtatggtagctgcctatacgtatggctttcccgttgccgaggaagcattcaagaatgctaaagtacctttggtgacgttgaccaattacgaagcagtacttgatgtagcacttcgtaccggttatatcgaagaagaagatattgcgacattgaacgattggcgtaaagacccggctcattgggatgcagggaaataatattgtattatttgatcggaaattttagtaagaaagaaccattcggacaatatctgttcggatagttctttctttgattttatacgaataaagaattatggctaattttgaaagtagtgtaaaggtaataccttacagtcaggaacgtgtgtatgccaagctgtcggacttgagcaacctggaatcagtgaaaggccgtttaccggaagataaaatacaggacttgagttttgattcggatacactgagctttagcgtttcgcctatcggtcagctgacgttgcagattgttgagcgtgaaccttgcaaatgtattaaactggcaactaccaactctccgctaccttttaatatgtggattcagctagtctcaacagcagaggaagagtgcaagttgaaagtgactatcagtatggatatcaatccgtttatgaaagcgatggtacagaaacctcttcaggatggtctggagaagatggttgagatgctgtcgatgattaactattaaacaggtaataagtaataaataataggtaatacccgcggagtatcaacgtaactacgattattacctattacttactacttattacctaatacttaaatattatggcgcagaaactttgggaaaaatccgtgcaggtaaataaagacatcgaacgttttacggtgggacgtgatcgtgagatggatctttatctggctaaacatgatgtactcggttctatggctcatattacgatgctcgaaagtatcggtctgttgaccaaggaagaactggaacagttgttggctgagttgaagactatttatgcttcggtcgaaagaggtgagtttataatagaagaaggagtagaggatgtgcattcgcaggtagaattgatgctgacccgccgtttgggagatgtcggtaagaagattcacagtggtcgttcacggaatgatcaggttttgctggacctcaaactctttacccgtacacagattcgcgagatcgcggaagcggtggaacaactctttcatgtgttgattcttcagagtgagcgatataaaaatgtcctgatgccgggatatacccatttgcagattgcgatgccttcatcctttggattgtggttcggtgcttatgccgaaagcctggtggatgatatgcagttcctacaagcggctttcaggatgtgcaatcgcaatcctttgggctctgcagcaggatatggctcctctttcccgttgaaccggacgatgacaaccgatttgttaggttttgattcgctgaattataatgtcgtttatgcgcagatgggacgtggcaagttggagcgtaatgttgcttttgcattggctaccattgccggaacgatctccaagctggcttttgatgcttgtatgttcaatagtcagaacttcggtttcgtgaagctgccggatgattgtactaccggttcgagcatcatgcctcataagaagaatccggatgtgttcgaactgacacgtgctaaatgtaataaactgcagtctcttcctcagcagataatgatgatagcaaacaatctgccatccggttacttccgtgacttacagattattaaagaggttttccttcccgcttttcaggaactgaaggactgcttgcagatgacgacttatatcatgaatgagattaaggtgaatgaacatatccttgatgatgataaatatctgtttattttcagtgtcgaggaagtgaatcgactggctcgtgaaggtatgcctttccgtgatgcgtataagaaagtcggtcttgatatagaagccggaaaatttactcatgacaaacaggtgcatcatacacacgaaggaagtatcggtaatctttgtaatgatgaaatctccgcattaatgcaacaagtggtcgatggcttcaatttctgtggaatggagcaggctgagaaagcattattagggcgataaaatattttctgccaaacttttttgatcgaaagtttggcagaaacaaggaaactcattatctttgcacccgttgaaaaaatgcggaaatagctcagttggtagagcataaccttgccaaggttagggtcgcgagttcgagtctcgttttccgctctctttgaaaggatgctcgaatggtggaatggtagacacgaaggacttaaaatcctttggccattgcggctgtgcgggttcaagtcccgcttcgagtacgagtattcctgattaaaagctctgtaaatcattgatttacggagctttttgtgtgtttctaccgccatatgccctgctgataaaggggcaattacaacctcaccgaatatatttgataattattgtcattgaatttatttttaatgttaaaaaagtatgtgatagatctactgagatttaatttcataccttgatatattatttagatagtatgttgatattttgtttggtgaataccttcatatatgctggttgttttacaatatttcttatgcattaaatagatgttaaatccagtcttttccttcgaactatctttttttgtgtgatgttgtttattttgagaacgttttgatacaatgtaaaagatattgcgcaattgaacagggtgaatagtatcttattataaatcgggagtaaactcttttgggaatgtttttgtgttttccatgtttttacgtttttctccctgctgtaagtgtggaggaggatgcaagggagtttacataattcaatatattatggacttacattcaggattgccctattgggttgttaaaaattcattgttagattactttcatcccttggaggatgatttttcaacagatattgtagttgtggggtctggtataacgggtgctttgatggtacacgagctttgtagtgccggtttaagatgttgcatggttgacaaacgaagcattgcaactggaagttccattgcaagtaccgctttactgcaatatgaaattgatgttcctctttgtgaaatggcagaaattattggagaggataatgctgtttctgcatatcgcgcatctttggcatcaattgctgatattgaaaaggtattaaaggaaacaggagtagatgctgattttgaaaaacgaccaagtcttttttatgctagtattccaaaggatatagaattaattgaaaaagaatatgtgatacgaaagaagcacaatttgccggttcgtttgctgggaaaagaggagataaaaaaactgtataatatagaggttccaggcaatgcactgttaaaccgagtatcggcgcagatggatgcttacaaagcgactactggtcttttgctctaccatatgaaaaaagatggactggaaatttttactcataccggtgtaacagaatgtgttgaaatgcctgaaggatatattatagaaacagatagagggcataaaatagagtgtaaatatgtgatcatcgcagccggatttgaagcagggaagtttttatctcgggaaattatggatttgacttcaacttatgcacttgtgtcgcatccggtagattctaaagatttgtggcctgaacagtgtttaatttgggaaacagctgagccatatttgtatatacggactacaaggggaaatcgtatcattgtcggtggtgaagatgaaaagttcagtgatccggagcgccgtgatgcgttactcagaaagaaaactcttgtattagaaaagaaatttaggagattatttccaagtattccttttaaaacagaaatggcgtggtgtggcacttttagtacaacaaaagatgggctaccctttatcggtaattgtccagataaggacaggatgttttttgatttgggatatggtggcaacggcataacctttagtatgattggagcacagattatctgcaagaagttgcaaggtatagatgatgaacgcggtaggattttcggttatgagagaattgaaaaatattggtaatttgcagagagtaaaagtcaatagtgactcaaatctacttcttgaaggagggaaattttgggagagttgctattgacttttgctgtactctcccatgtttagaattatattcatataaatattgctttctgatgtagctaatatttttgaactccagtacccagccattgcggcattcgtgccttgccgtagaaataatagaacagcaatcctatccagctggtaagaacgattaagataatagctatcagccgtctttctattggtgcatggatacgccatatttccagtgcggctttgatagtcagtactaatccaacaatccatattacaaatccaaccatagcttattaatatgtaagaagttactatttatagaatgatatacgattaagaatcagtcaagttttttacttacatcttttttcacttcgttatatccttccttgatttctttcttggttttctctgcgctgttttgaacgtcttttttggtgtctttccacgcatcttttacggcatcagcaccatcttcgattttatcggatactttgtccactgcatcattgacgttttctttcactttttcaacttgttgtttcgctttatcctgttcttttttattacgacaggacgtgaaggatattatagttgtaactacaaaaatcgcaaataataattttttcatattcttttaatttaaaattgtaaagtcactttgagaataaattggtggattcttcaggcagattcctgtctgcctgaagaatgacacaaacttaacgattctgaatgcctatttcttttcagtttttttgcttgaagtcgaagacttgcactctttagcttgggcggtctttttagtgccctttgcctcttcctgtttcttttcagttttcttgttcataattcaaaagttttagttaataatttaggtttattcagaaacactctagtgttcttaattggtttactagaatctgtttcatttttttgcatcagcagctattgtatgcattttgcctttaaggtcatctgccttttcagctaggtcgaaagttttgtctgcaactttatcggctacggcagcacccgtatccaatactttttcctttgcagtatctaacatttcttcgacttgcccacttattttatgaaaggcatcacatacttttttctttagttttttggctttagaagttcgtgaaaaacgatagacgagggcgccaatgaccgatcctataccaagaccgagccataaatcagaagttctattttccataattaagttggttttagatagttaaaaatagagtttggtaataagtaagaaactgtatgtaagttaagttcttaaagtcacatacttattagtgggtttatatgtaaatatatagatatataattagtattttataaaggaaaaatattttgcttgttgaatggaaaaatatttattcatatcgctagaatattcatctttatagtcagcttgtttgctgtctcatacttgataaacaataaattattgttcctatgatagaactgactattaatctgatccataaatttgaacttatacttttcatggctgtagattttattgatgaaacaatgtttaaaacttattttttttagaaaaatatgtaggtttactctattacacttccccgatttattatgttacttttgttatatcatccgaaatgtacttaagctcctactgtatgaaaaaaaacacgggattaaaaaaaatagttcgaagtttgaaaatggaattaacatcattttttattttatggaaaattgaaaaagaggcttatggattttaaatgcatagccgaaggaataaatatatgattgaaattgtcctaataataagatgattcctgttcgtgtatatttatgatctgatgctggaaaatcgtacaaaaaatgactaatataatttagaaagaacacttatctatttccgatgtttttattggggagtatttggggtattatgcggtatttccgatagatgagatagttgtgttttttaagtttctgtttttaacatataattattaatttattcagttgctgtttaaataatattttcatatttttgcaaatatatttttgagtgttttgtgaaaggaatgaagataattgtaaaaaatagaaaacttttagtgtttatagttcttctcattagtagtgctgtgagcaaggggcagatttataagtacatagggttggaagacggtttgaacaaccagaaaatctaccatattcaaaaagaccgacgcggatatatgtggtttttgactcaggagggggtagatcgttatgacggtaaacacatcaagcattatactttctcggatgacagtatgaagctggactcacggat
